United States Patent 11,446,398 (REGULATED BIOCIRCUIT SYSTEMS) - sequence listing, part 54

SEQ ID NO: 147400 - DNA, 9687 bp, Homo sapiens
  Payload ID: 9155
  Gene Symbol: LAMA2
  Gene Name: laminin, alpha 2
  ENST ID: ENST00000618192
  CDS Start-End: 106-9471
ttccccagcagctgctgctcgctcagctcacaagccaaggccaggggacagggcggcagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccagagacacccgattacaaatgctattgatggaaagaacacttggtggcagagtcccagtattaagaatggaatcgaataccattatgtgacaattaccctggatttacagcaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagatattactactcggtcaaggatatttcagttggagggatgtgcatctgctatggtcatgccagggcttgtccacttgatccagcgacaaataaatctcgctgtgagtgtgagcataacacatgtggcgatagctgtgatcagtgctgtccaggattccatcagaaaccctggagagctggaacttttctaactaaaactgaatgtgaagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtactgatggcttcttcagacccaaaggggtatctccaaattatccaaggccatgccagccatgtcattgcgatccaattggttccttaaatgaagtctgtgtcaaggatgagaaacatgctcgacgaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaaatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaactcccagcagtaggaggacagttgacatttaccatatcatatgaccttgaagaagaggaagaagatacagaacgtgttctccagcttatgattatcttagagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggttgagctctgttaaccttgaatccgctgtctcctatcctactgatggaagcattgcagcagctgtagaagtgtgtcagtgcccaccagggtatactggctcctcttgtgaatcttgttggcctaggcacaggcgagttaacggcactatttttggtggcatctgtgagccatgtcagtgctttggtcatgcggagtcctgtgatgacgtcactggagaatgcctgaactgtaaggatcacacaggtggcccatattgtgataaatgtcttcctggtttctatggcgagcctactaaaggaacctctgaagactgtcaaccctgtgcctgtccactcaatatcccatccaataactttagcccaacgtgccatttagaccggagtcttggattgatctgtgatggatgccctgtcgggtacacaggaccacgctgtgagaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagccctgtcgctgtaatgccggtggctctttctctgaggtttgccacagtcaaactggacagtgtgagtgcagagccaacgttcagggtcagagatgtgacaaatgcaaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacagcttgtgaatgttctcatctgggtaataattgtgacccaaagactgggcgatgcatttgccctcccaataccattggagagaaatgttctaaatgtgcacccaatacctggggccacagcattaccactggttgtaaggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagagaaagaatggaaatattatggggatgatcctcgagtccatagaactgtgacccgagaagacttcttggatatactatatgatattcattacattcttatcaaagctacttatggaaatttcatgcgacaaagcaggatttctgaaatctcaatggaggtagctgaacaaggacgtggaacaacaatgactcctccagctgacttgattgaaaaatgtgattgtcccctgggctattctggcctgtcctgtgaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccagaattgtcaacatcacactgctggtgacttctgtgaacgatgtgctcttggatactatggaattgtcaagggattgccaaatgactgtcagcaatgtgcctgccctctgatttcttccagtaacaatttcagcccctcttgtgtcgcagaaggacttgacgactaccgctgcacggcttgtccacggggatatgaaggccagtactgtgaaaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgttttttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaagcacttgctgtcacctcagcgggccccagagaggcttattcagctggcagagggcaatctgaatacactcgtgaccgaaatgaacgagctgctgaccagggctaccaaagtgacagcagatggcgagcagaccggacaggatgctgagaggaccaacacaagagcaaagtccctgggagaattcattaaggagcttgcccgggatgcagaagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggagaaaaagaaggaggctgttgaaagcggcaaacgacaaattgagaacactttaaaagagggcaatgacatactcgatgaagccaaccgtcttgcagatgaaatcaactccatcatagactatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatggaatccttgatgaggctaaaaacatctccttcaatgccactgcagccttcaaagcttacagcaatattaaggactatattgatgaagctgagaaagttgccaaagaagccaaagatcttgcacatgaagctacaaaactggcaacaggtcctcggggtttattaaaggaagatgccaaaggctgtcttcagaaaagcttcaggattcttaacgaagccaagaagttagcaaatgatgtaaaagaaaatgaagaccatctaaatggcttaaaaaccaggatagaaaatgctgatgctagaaatggggatctcttgagaactttgaatgacactttgggaaagttatcagctattccaaatgatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacacagttgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttattgactttctggctatagaaatgcgtaaaggcaaagtcagcttcctctgggatgttggatctggagttggacgtgtagagtacccagatttgactattgatgactcatattggtaccgtatcgtagcatcaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaagaaggctgatgctgtacgtgtgattacattcactggctgcatgggagaaacatactttgacaacaaacctataggtttgtggaatttccgagaaaaagaaggtgactgcaaaggatgcactgtcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctgagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaagccaatatatcaattgtagatatagatactaatcaggaggagaatatagcaacttcgtcttctggaaacaactttggtcttgacttgaaagcagatgacaaaatatattttggtggcctgccaacgctgagaaacttgagtatgaaagcaaggccagaagtaaatctgaagaaatattccggctgcctcaaagatattgaaatttcaagaactccgtacaatatactcagtagtcccgattatgttggtgttaccaaaggatgttccctggagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgcaatactcctcaacaggggccgtctggaagtgcatctctccacaggggcacgaacaatgaggaaaattgtgatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggatcagtagtcaaaaaatggatggaatgggtattgaaatgattgatgaaaagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaataatattaaactgattatttcattct

SEQ ID NO: 147401 - DNA, 9678 bp, Homo sapiens
  Payload ID: 9155
  Gene Symbol: LAMA2
  Gene Name: laminin, alpha 2
  ENST ID: ENST00000617695
  CDS Start-End: 106-9462
ttccccagcagctgctgctcgctcagctcacaagccaaggccaggggacagggcggcagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccagagacacccgattacaaatgctattgatggaaagaacacttggtggcagagtcccagtattaagaatggaatcgaataccattatgtgacaattaccctggatttacagcaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagatattactactcggtcaaggatatttcagttggagggatgtgcatctgctatggtcatgccagggcttgtccacttgatccagcgacaaataaatctcgctgtgagtgtgagcataacacatgtggcgatagctgtgatcagtgctgtccaggattccatcagaaaccctggagagctggaacttttctaactaaaactgaatgtgaagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtactgatggcttcttcagacccaaaggggtatctccaaattatccaaggccatgccagccatgtcattgcgatccaattggttccttaaatgaagtctgtgtcaaggatgagaaacatgctcgacgaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaaatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaactcccagcagtaggaggacagttgacatttaccatatcatatgaccttgaagaagaggaagaagatacagaacgtgttctccagcttatgattatcttagagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggttgagctctgttaaccttgaatccgctgtctcctatcctactgatggaagcattgcagcagctgtagaagtgtgtcagtgcccaccagggtatactggctcctcttgtgaatcttgttggcctaggcacaggcgagttaacggcactatttttggtggcatctgtgagccatgtcagtgctttggtcatgcggagtcctgtgatgacgtcactggagaatgcctgaactgtaaggatcacacaggtggcccatattgtgataaatgtcttcctggtttctatggcgagcctactaaaggaacctctgaagactgtcaaccctgtgcctgtccactcaatatcccatccaataactttagcccaacgtgccatttagaccggagtcttggattgatctgtgatggatgccctgtcgggtacacaggaccacgctgtgagaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagccctgtcgctgtaatgccggtggctctttctctgaggtttgccacagtcaaactggacagtgtgagtgcagagccaacgttcagggtcagagatgtgacaaatgcaaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacagcttgtgaatgttctcatctgggtaataattgtgacccaaagactgggcgatgcatttgccctcccaataccattggagagaaatgttctaaatgtgcacccaatacctggggccacagcattaccactggttgtaaggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagagaaagaatggaaatattatggggatgatcctcgagtccatagaactgtgacccgagaagacttcttggatatactatatgatattcattacattcttatcaaagctacttatggaaatttcatgcgacaaagcaggatttctgaaatctcaatggaggtagctgaacaaggacgtggaacaacaatgactcctccagctgacttgattgaaaaatgtgattgtcccctgggctattctggcctgtcctgtgaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccagaattgtcaacatcacactgctggtgacttctgtgaacgatgtgctcttggatactatggaattgtcaagggattgccaaatgactgtcagcaatgtgcctgccctctgatttcttccagtaacaatttcagcccctcttgtgtcgcagaaggacttgacgactaccgctgcacggcttgtccacggggatatgaaggccagtactgtgaaaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgttttttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaagcacttgctgtcacctcagcgggccccagagaggcttattcagctggcagagggcaatctgaatacactcgtgaccgaaatgaacgagctgctgaccagggctaccaaagtgacagcagatggcgagcagaccggacaggatgctgagaggaccaacacaagagcaaagtccctgggagaattcattaaggagcttgcccgggatgcagaagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggagaaaaagaaggaggctgttgaaagcggcaaacgacaaattgagaacactttaaaagagggcaatgacatactcgatgaagccaaccgtcttgcagatgaaatcaactccatcatagactatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatggaatccttgatgaggctaaaaacatctccttcaatgccactgcagccttcaaagcttacagcaatattaaggactatattgatgaagctgagaaagttgccaaagaagccaaagatcttgcacatgaagctacaaaactggcaacaggtcctcggggtttattaaaggaagatgccaaaggctgtcttcagaaaagcttcaggattcttaacgaagccaagaagttagcaaatgatgtaaaagaaaatgaagaccatctaaatggcttaaaaaccaggatagaaaatgctgatgctagaaatggggatctcttgagaactttgaatgacactttgggaaagttatcagctattccaaatgatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacaatgcagttgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttattgactttctggctatagaaatgcgtaaaggcaaagtcagcttcctctgggatgttggatctggagttggacgtgtagagtacccagatttgactattgatgactcatattggtaccgtatcgtagcatcaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaagaaggctgatgctgtacgtgtgattacattcactggctgcatgggagaaacatactttgacaacaaacctataggtttgtggaatttccgagaaaaagaaggtgactgcaaaggatgcactgtcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctgagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaagccaatatatcaattgtagatatagatactaatcaggaggagaatatagcaacttcgtcttctggaaacaactttggtcttgacttgaaagcagatgacaaaatatattttggtggcctgccaacgctgagaaacttgaggccagaagtaaatctgaagaaatattccggctgcctcaaagatattgaaatttcaagaactccgtacaatatactcagtagtcccgattatgttggtgttaccaaaggatgttccctggagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggcctattatgcaatactcctcaacaggggccgtctggaagtgcatctctccacaggggcacgaacaatgaggaaaattgtgatcagaccagagccgaatctgtttcatgatggaagagaacattccgttcatgtagagcgaactagaggcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatggtccttgtgctgcagaatcagaaccagctcttttgatagggagcaagcagttcgggctttcaagaaacagtcacattgcaattgcatttgatgacaccaaagttaaaaaccgtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcagttggtggattcaaagtgggattggaccttcttgtagaatttgaattccgcacaactacaacgactggagttcttctggggatcagtagtcaaaaaatggatggaatgggtattgaaatgattgatgaaaagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaataatattaaactgattatttcattct

SEQ ID NO: 147402 - DNA, 5671 bp, Homo sapiens
  Payload ID: 9156
  Gene Symbol: LAMA3
  Gene Name: laminin, alpha 3
  ENST ID: ENST00000269217
  CDS Start-End: 206-5380
aattacagagcggtgcgcttacctgcgggactgttatgtgcgctctggcacaggctgactcatgtgtgaagtttaaaggtggggcccctgccgcagacagccttcctcacctgagtcaggcaggcccgggcactgagcaggaagggcaggtataagaggaagaggcagaggttcctgcgcagccagcggacgtccaggaaccgggatgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcactcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtctttt

SEQ ID NO: 147403 - DNA, 10661 bp, Homo sapiens
  Payload ID: 9156
  Gene Symbol: LAMA3
  Gene Name: laminin, alpha 3
  Uniprot ID: Q16787
  ENST ID: ENST00000313654
  CDS Start-End: 242-10243
gagcgctgtcagttcctgatccggctggtgcccgctccagccgcggcaggttccagagctgagaggccacccccacgccgcgggcttccagcgcgtggagcaaggggagcggccccggcgccgcccatatccccggctgcgctagtcctggcgctgcaggtccgggaggcgcaggcggagagcggcggtgcccccgagcccctctgcggacggctcaggcgggaggaccccgcgcggctggatggcggcggccgcgcggcctcggggtcgggcactggggccagtactgccgccgacgccgctgctcctgctggtactgcgggtgctgccagcctgcggggcgaccgctcgggatcccggggccgcggccgggctcagccttcacccgacttacttcaacctggccgaggcggcgaggatttgggccaccgccacctgcggggagaggggacccggcgaggggaggccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgatctttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatactacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaagcctgctggtgttcagcccttggatcctaccagatgccctgcagctcagtgactggacagtgtgaatgtcggccaggagttacaggacagcggtgtgacaggtgtctctcaggagcttatgatttcccccactgccaaggttccagcagtgcttgtgacccagctggtaccatcaactccaatttggggtattgccaatgcaagcttcatgttgaaggtcctacttgtagccgctgcaaactgttatattggaatctggacaaagaaaaccccagtggatgttcagaatgcaagtgccataaggcgggaacagtgagtggaactggagagtgtaggcagggagatggtgactgtcactgcaagtcccatgtgggtggcgattcctgcgacacctgtgaagatggatattttgctttggaaaagagcaattactttgggtgtcaagggtgtcagtgtgacattggtggggcattgtcctccatgtgcagtgggccctcgggagtgtgccagtgccgagagcatgtcgtgggaaaggtgtgccagcggcctgaaaacaactactatttcccagatttgcatcatatgaagtatgagattgaagacggcagcacacctaatgggagagaccttcgatttggatttgatccgctggcatttcctgagtttagctggagaggatatgcccaaatgacctcagtacagaatgatgtaagaataacattgaatgtagggaagtcaagtggctccttgtttcgtgttattctgagatacgttaaccctggaactgaagcagtatctggccatataactatttatccatcctggggtgctgctcaaagcaaagagatcatcttcctgccgagtaaggagccagcctttgtcactgtccctggaaatggttttgcagacccattttcaatcacaccaggaatatgggttgcttgtattaaggcagaaggagtccttctggattacctggtgctgctccccagggactactatgaagcctctgtactgcagctgccagtcacagaaccatgtgcctacgcaggacctccccaagaaaattgcttactctaccagcatttgccagtgaccagattcccctgtaccctggcttgtgaggccagacacttcctgcttgatggggagccaagacccgtggcagtgaggcagcccacacctgcacaccctgtcatggtggacctcagcgggagagaggtggaattgcatctgcggctgcgcatcccacaggttggccactacgtggttgtggtcgagtattccacggaggcagctcagctgtttgtggttgatgtgaatgtgaagagctccgggtctgttctggcaggccaggtgaacatttacagctgcaactacagtgttctctgccggagtgctgtgattgatcacatgagccgcatcgccatgtatgagctattggcagatgcagacattcagctcaagggacacatggcccgattccttctgcatcaagtttgtatcatacctattgaagaattctcagctgagtatgtgagaccacaagtccactgcattgccagttatgggcgatttgtcaatcaaagtgccacctgtgtctccttggcccatgaaactcctccaacagcattaattttggatgttctaagtggcaggcctttccctcacctgccccagcagtcgtcaccttctgttgatgttcttcctggggtcaccttgaaggcaccgcagaatcaagtgaccctgagaggacgtgtaccacacctgggccgatacgtctttgtcatccatttttaccaagcagcgcacccgacgtttcccgcgcaggtgtcggtggatggcgggtggccacgggcaggctccttccatgcctctttttgcccccatgtgcttggctgccgggatcaagtgattgccgaaggccagattgagtttgacatctcagagcctgaagtggccgcaactgtgaaggttccagaaggaaagtccttggttttggtccgtgttctagtggtgcctgcagaaaactatgactaccaaatacttcacaaaaaatccatggacaagtcactcgagtttatcaccaattgtggaaaaaacagcttttaccttgacccccagacagcctccagattctgtaagaattccgccaggtccctggtggccttttaccacaagggcgccctgccttgtgagtgccaccccactggggccaccggccctcactgcagccctgagggtgggcagtgcccatgccagcccaacgtcatcgggcggcagtgcacccgctgtgcaacaggccactacggattcccacgctgcaagccgtgcagctgtggtcggcgcctttgtgaagagatgacggggcagtgccgctgccctccccgcacggtcaggccccagtgtgaggtgtgtgagacacactcattcagcttccaccccatggccggctgcgaaggctgcaactgttccaggaggggcaccatcgaggctgccatgccggagtgtgaccgggacagcgggcagtgcagatgcaagcccagaatcacagggcggcagtgtgaccgatgtgcttccgggttttaccgctttcctgagtgtgttccctgcaattgcaacagagatgggactgagccaggagtgtgtgacccagggaccggggcttgcctctgcaaggaaaatgtagaaggcacagagtgtaatgtgtgtcgagaaggctcattccatttggacccagccaatctcaagggttgtaccagctgtttctgttttggagtaaataatcaatgtcacagctcacataagcgaaggactaagtttgtggatatgctgggctggcacctggagacagcagacagagtggacatccctgtctctttcaacccaggcagcaacagtatggtggcggatctccaggagctgcccgcaaccatccacagcgcgtcctgggtcgcacccacctcctacctgggggacaaggtttcttcatatggtggttacctcacttaccaagccaagtcctttggcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcactcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtccttaaa

SEQ ID NO: 147404 - DNA, 9834 bp, Homo sapiens
  Payload ID: 9156
  Gene Symbol: LAMA3
  Gene Name: laminin, alpha 3
  ENST ID: ENST00000399516
  CDS Start-End: 1-9834
atggcggcggccgcgcggcctcggggtcgggcactggggccagtactgccgccgacgccgctgctcctgctggtactgcgggtgctgccagcctgcggggcgaccgctcgggatcccggggccgcggccgggctcagccttcacccgacttacttcaacctggccgaggcggcgaggatttgggccaccgccacctgcggggagaggggacccggcgaggggaggccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgatctttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatactacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaagcctgctggtgttcagcccttggatcctaccagatgccctgcagctcagtgactggacagtgtgaatgtcggccaggagttacaggacagcggtgtgacaggtgtctctcaggagcttatgatttcccccactgccaaggttccagcagtgcttgtgacccagctggtaccatcaactccaatttggggtattgccaatgcaagcttcatgttgaaggtcctacttgtagccgctgcaaactgttatattggaatctggacaaagaaaaccccagtggatgttcagaatgcaagtgccataaggcgggaacagtgagtggaactggagagtgtaggcagggagatggtgactgtcactgcaagtcccatgtgggtggcgattcctgcgacacctgtgaagatggatattttgctttggaaaagagcaattactttgggtgtcaagggtgtcagtgtgacattggtggggcattgtcctccatgtgcagtgggccctcgggagtgtgccagtgccgagagcatgtcgtgggaaaggtgtgccagcggcctgaaaacaactactatttcccagatttgcatcatatgaagtatgagattgaagacggcagcacacctaatgggagagaccttcgatttggatttgatccgctggcatttcctgagtttagctggagaggatatgcccaaatgacctcagtacagaatgatgtaagaataacattgaatgtagggaagtcaagtggctccttgtttcgtgttattctgagatacgttaaccctggaactgaagcagtatctggccatataactatttatccatcctggggtgctgctcaaagcaaagagatcatcttcctgccgagtaaggagccagcctttgtcactgtccctggaaatggttttgcagacccattttcaatcacaccaggaatatgggttgcttgtattaaggcagaaggagtccttctggattacctggtgctgctccccagggactactatgaagcctctgtactgcagctgccagtcacagaaccatgtgcctacgcaggacctccccaagaaaattgcttactctaccagcatttgccagtgaccagattcccctgtaccctggcttgtgaggccagacacttcctgcttgatggggagccaagacccgtggcagtgaggcagcccacacctgcacaccctgtcatggtggacctcagcgggagagaggtggaattgcatctgcggctgcgcatcccacaggttggccactacgtggttgtggtcgagtattccacggaggcagctcagctgtttgtggttgatgtgaatgtgaagagctccgggtctgttctggcaggccaggtgaacatttacagctgcaactacagtgttctctgccggagtgctgtgattgatcacatgagccgcatcgccatgtatgagctattggcagatgcagacattcagctcaagggacacatggcccgattccttctgcatcaagtttgtatcatacctattgaagaattctcagctgagtatgtgagaccacaagtccactgcattgccagttatgggcgatttgtcaatcaaagtgccacctgtgtctccttggcccatgaaactcctccaacagcattaattttggatgttctaagtggcaggcctttccctcacctgccccagcagtcgtcaccttctgttgatgttcttcctggggtcaccttgaaggcaccgcagaatcaagtgaccctgagaggacgtgtaccacacctgggccgatacgtctttgtcatccatttttaccaagcagcgcacccgacgtttcccgcgcaggtgtcggtggatggcgggtggccacgggcaggctccttccatgcctctttttgcccccatgtgcttggctgccgggatcaagtgattgccgaaggccagattgagtttgacatctcagagcctgaagtggccgcaactgtgaaggttccagaaggaaagtccttggttttggtccgtgttctagtggtgcctgcagaaaactatgactaccaaatacttcacaaaaaatccatggacaagtcactcgagtttatcaccaattgtggaaaaaacagcttttaccttgacccccagacagcctccagattctgtaagaattccgccaggtccctggtggccttttaccacaagggcgccctgccttgtgagtgccaccccactggggccaccggccctcactgcagccctgagggtgggcagtgcccatgccagcccaacgtcatcgggcggcagtgcacccgctgtgcaacaggccactacggattcccacgctgcaagccgtgcagctgtggtcggcgcctttgtgaagagatgacggggcagtgccgctgccctccccgcacggtcaggccccagtgtgaggtgtgtgagacacactcattcagcttccaccccatggccggctgcgaaggctgcaactgttccaggaggggcaccatcgaggctgccatgccggagtgtgaccgggacagcgggcagtgcagatgcaagcccagaatcacagggcggcagtgtgaccgatgtgcttccgggttttaccgctttcctgagtgtgttccctgcaattgcaacagagatgggactgagccaggagtgtgtgacccagggaccggggcttgcctctgcaaggaaaatgtagaaggcacagagtgtaatgtgtgtcgagaaggctcattccatttggacccagccaatctcaagggttgtaccagctgtttctgttttggagtaaataatcaatgtcacagctcacataagcgaaggactaagtttgtggatatgctgggctggcacctggagacagcagacagagtggacatccctgtctctttcaacccaggcagcaacagtatggtggcggatctccaggagctgcccgcaaccatccacagcgcgtcctgggtcgcacccacctcctacctgggggacaaggtttcttcatatggtggttacctcacttaccaagccaagtcctttggcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacatgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaa

SEQ ID NO: 147405 - DNA, 3494 bp, Homo sapiens
  Payload ID: 9156
  Gene Symbol: LAMA3
  Gene Name: laminin, alpha 3
  ENST ID: ENST00000586751
  CDS Start-End: 1-3442
ctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctgggctgaggcaagagggttgcttgaggccaagagttcgagaccagtcttggaaacacagtgaaaccatgtctctacgaaaactaaaataaaataaaatgtaaataaataaaattttaaaaataaatcagttggatggataaa

SEQ ID NO: 147406 - DNA, 5007 bp, Homo sapiens
  Payload ID: 9156
  Gene Symbol: LAMA3
  Gene Name: laminin, alpha 3
  ENST ID: ENST00000587184
  CDS Start-End: 1-5007
atgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacatgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaa

SEQ ID NO: 147407 - DNA, 462 bp, Homo sapiens
  Payload ID: 9156
  Gene Symbol: LAMA3
  Gene Name: laminin, alpha 3
  ENST ID: ENST00000590104
  CDS Start-End: 1-112
tggatggactgagggcccgggagggaagtttgcctggaaactccaccatcagcatcagagcgccagtttacctgggatcacctccatcagggaaaccaaaggtgcaggttgagacgcaggccctgaaagggtgaagatagagcttctctgccacttcctaaacctgaatctattggcttctcctccagggaatgcaaaaacgtaggttttaggttatagacagagattttttggttaacataatgtgtttcaaattacagtaatttgtgccattttcaccatctttgccataaggtaaaacattggcttaactgttttctctccatcaaactatttattttaaatgtgcttctatgggatctttttatctctcccataaatggaaacccaatattctttaccataaataatagataaccctgagaaataaacatttgaaaaccaaacactgttaatatcaaa

SEQ ID NO: 147408 - DNA, 771 bp, Homo sapiens
  Payload ID: 9156
  Gene Symbol: LAMA3
  Gene Name: laminin, alpha 3
  ENST ID: ENST00000588164
  CDS Start-End: 1-285
cttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctgggtgagtggaataatacttctgtcagagctgtgagtgagttttactctctttcgtttaatggaattttctggtgtctttttgcaaaatatttgtccttgataccaaaaatacttcactaataagtcttgtccttcttcctttttccatatcaatttcttcataaaaaaataaactgccacacatggtggctcatgtctgtaatcccaacaactaagaaggctgaggcaagagggttgcttgaggccaagagttcgagaccagtcttggaaacacagtgaaaccatgtctctacgaaaactaaaataaaataaaatgtaaataaataaaattttaaaaataaatcagttggatggataaattgtggtgtattcaaatggaatgctatatagcaatgagaaagaaggatctagaactatatgtaatgacatgaatgaccctcacaaacataatgtggaaaacattgagtcacacataaaagttcatctcatat

SEQ ID NO: 147409 - DNA, 590 bp, Homo sapiens
  Payload ID: 9156
  Gene Symbol: LAMA3
  Gene Name: laminin, alpha 3
  ENST ID: ENST00000592519
  CDS Start-End: 1-178
ggcaggccaggtgaacatttacagctgcaactacaggtgcgatgcaatgaactcactgctctcacctcaaaggctgtgtcaagtacctgggtgcatagcacaaggaaaaagactcattctcagtaatgttagggggtgcacacctacctttgcaacacaccttcagaactggggataattaatgtttgatgattgtcaagtggaaaaaaaaattaacaaaggacttcaaaatttgccctgatgaagttcttctcttccaagagcactaactgacaagggcttattaaaaatggttttgtttgcataatatttcaagatgtgtgcaaatgttcagagcatgctgtaattaaagaatcagcacaaggggtgtttccacatgaaattaattgtatactaaatgggactggaagtcagagttccttgaaacagcagatggagcactgcagtaaacccatccagttcttggccatggccttgaacattgtattactactactttcatgttgctttttgtcaaacccaagatgacctgaagcaatggacatcttccctgttgtgaaaatgaaaacaaataaacaaataaacaaaaa

SEQ ID NO: 147410 - DNA, 554 bp, Homo sapiens
  Payload ID: 9156
  Gene Symbol: LAMA3
  Gene Name: laminin, alpha 3
  ENST ID: ENST00000588004
  CDS Start-End: 1-403
tttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcactcaggacacaaaccagacaggtttaatagcgaatctaattttgaattctgaccatggatacc

SEQ ID NO: 147411 - DNA, 1815 bp, Homo sapiens
  Payload ID: 9156
  Gene Symbol: LAMA3
  Gene Name: laminin, alpha 3
  ENST ID: ENST00000585600
  CDS Start-End: 87-1815
gcaggtccgggaggcgcaggcggagagcggcggtgcccccgagcccctctgcggacggctcaggcgggaggaccccgcgcggctggatggcggcggccgcgcggcctcggggtcgggcactggggccagtactgccgccgacgccgctgctcctgctggtactgcgggtgctgccagcctgcggggcgaccgctcgggatcccggggccgcggccgggctcagccttcacccgacttacttcaacctggccgaggcggcgaggatttgggccaccgccacctgcggggagaggggacccggcgaggggaggccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgatctttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatactacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaaggacccagtgaaaaggtggccatctacaagccagaaagcaggccctcagcagaaactgaaccagccagcacctggatcttggacttcccagcctccagaactggagaaataaatttctattgtttaa

SEQ ID NO: 147412 - DNA, 6547 bp, Homo sapiens
  Payload ID: 9157
  Gene Symbol: LAMA4
  Gene Name: laminin, alpha 4
  ENST ID: ENST00000230538
  CDS Start-End: 399-5870
gaatattcttctggagcccttggaggggctccaaactgagaggggagggaagaccgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaactatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcggtggccctgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttgtttttagcccttttgtttggtctatcagtataagaagaatattttaggtttatagctgaagttatcaaggtttaataaagtaaatttctaacagaatactagaaaaatgcagtataatttaattttttctaaataagaaacacaggaaatcaactactttttccccttccttatctccttaaaagaaaaataaaattgtacatgaga

SEQ ID NO: 147413 - DNA, 541 bp, Homo sapiens
  Payload ID: 9157
  Gene Symbol: LAMA4
  Gene Name: laminin, alpha 4
  ENST ID: ENST00000243219
  CDS Start-End: 279-541
agtcccgaacggccagggagaggaggtggcctagcgctggcggggctcaccccaatccgtctgccttttgatgccgtactgtaagctccgtccatctgtaggttcttgagccagaacctctgcgggaaggagaaaaactgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattc

SEQ ID NO: 147414 - DNA, 1061 bp, Homo sapiens
  Payload ID: 9157
  Gene Symbol: LAMA4
  Gene Name: laminin, alpha 4
  Uniprot ID: Q16363
  ENST ID: ENST00000368638
  CDS Start-End: 272-634
gggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgaggtacagtgtccctgccattgccaccctgctggggcacctgcgcccccgcgggctgtgccacactcgtccttctctctctctccgcctctttcctctccccagtgccttgagagtttcacctgggctaggtcagttcggaaacttgaaataaagagttttcctttgtaagttgcatttggatgttgagagttgaaagttgaggcttcggaatgtgtctgctcaaaggggtgagagtgcatgtgttggtgctctgagttcatccgctagactctcaccggggactgcagcagcacatcggtgacttctgccacttgcgtgtcccagtagtcattttgtcaagccacggcacttaacgtgtgtgccctgtcactggcttcctgctcctctgtgctgttaggacagtgggaacactactgcaggatctttttgtctcatattagacaagaagtcttctgcagcagggaaggtgagggggtgagtgagagtggctggtcatgaaaggagctgttagacaactgctgagagggtatcttaagtagaaacgagccattgtattccagaaacaagatgtttccattaaaatcaagcctcagga

SEQ ID NO: 147415 - DNA, 672 bp, Homo sapiens
  Payload ID: 9157
  Gene Symbol: LAMA4
  Gene Name: laminin, alpha 4
  ENST ID: ENST00000368640
  CDS Start-End: 1-536
tgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaagcactggaacaagccaagaagaagactggaattgcaggaaggagtataatgactcagaagacagtgtccattcagagagcccacagtttatgaagggactgatgaccacattgccgctgcacagtgggctctgtgactacaggagccttgctctgtagggaggggattacccttctccaataaaa

SEQ ID NO: 147416 - DNA, 6297 bp, Homo sapiens
  Payload ID: 9157
  Gene Symbol: LAMA4
  Gene Name: laminin, alpha 4
  ENST ID: ENST00000389463
  CDS Start-End: 284-5734
agaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaactatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcggtggccctgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttgtttttagcccttttgtttggtctatcagtataagaagaatattttaggtttatagctgaagttatcaaggtttaataaagtaaatttctaaca

SEQ ID NO: 147417 - DNA, 645 bp, Homo sapiens
  Payload ID: 9157
  Gene Symbol: LAMA4
  Gene Name: laminin, alpha 4
  Uniprot ID: Q16363
  ENST ID: ENST00000453937
  CDS Start-End: 279-641
agaatgaatgtgagaaggaagccaggacagcgcagtccccagtcccgaacggccagggagaggaggtggcctagcgctggcggggctcaccccaatccgtctgccttttgatgccgtactgtaagctccgtccatctctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgaggtacagtgtccctgccattgccaccctgctggggcacctgcgcccccgcgggctgtgccacactcgtccttctctctctctccgcctctttcctctccccagtgccttgagagtttcacctgggctaggtcagttcggaaacttgaaataaagagttttcctttgtaagttg

SEQ ID NO: 147418 - DNA, 554 bp, Homo sapiens
  Payload ID: 9157
  Gene Symbol: LAMA4
  Gene Name: laminin, alpha 4
  Uniprot ID: Q16363
  ENST ID: ENST00000455073
  CDS Start-End: 194-554
gacctcagtgtctgaaaagccagcttagagtgggagggcctgggagtagaagctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgaggtacagtgtccctgccattgccaccctgctggggcacctgcgcccccgcgggctgtgccacactcgtccttctctctctctccgcctctttcctctccccagtgccttgagagtttcacctgggctaggtcagttcggaaacttgaaataaagagttttcctttgt

SEQ ID NO: 147419 - DNA, 1080 bp, Homo sapiens
  Payload ID: 9157
  Gene Symbol: LAMA4
  Gene Name: laminin, alpha 4
  ENST ID: ENST00000431543
  CDS Start-End: 256-645
aatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgactactgacggagaagacccaggtttttcagcttctgccctatcgttcattctcagctctcagggagccagagaagccagggctccaacatgaacacttcttgtagctcactgtcatgaccagtgtttcagtcagttcttgcaggttgcctgacttacctcatttctctcatttcctgtaagcaaccaaaaataaaaggctttcttttatttcattttgtcttattttgcttttatcttgaaggcatataagacctctgtatctgccttgttcaccttcaactgcttctaattcttcctcaattccagtgtccaatgtcaatttgaaattaaaatttacagactgattttaactaagctgttggtaaagctgacctaagccattcagccacaaaatatagagtatacaaaattatgctaccattttacacatatcaagcaagcaaagagatttttttttactggtggaacactaatctttcaaatatagaatagtggctaaatgaaaataaaacagcttagaaatcta

SEQ ID NO: 147420 - DNA, 5983 bp, Homo sapiens
  Payload ID: 9157
  Gene Symbol: LAMA4
  Gene Name: laminin, alpha 4
  ENST ID: ENST00000424408
  CDS Start-End: 389-5839
agtcccgaacggccagggagaggaggtggcctagcgctggcggggctcaccccaatccgtctgccttttgatgccgtactgtaagctccgtccatctgtaggttcttgagccagaacctctgcgggaaggagaaaaagtgaaagagggagagggagagggagagagagggggagaaggggagagagagagagggagagagaggctggaactctcccttactctcgcactttccctttatttcctaagctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaactatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcggtggccctgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccgg

SEQ ID NO: 147421 - DNA, 1054 bp, Homo sapiens
  Payload ID: 9157
  Gene Symbol: LAMA4
  Gene Name: laminin, alpha 4
  ENST ID: ENST00000523765
  CDS Start-End: 1-566
taaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggtaagcatcagagagaattgaagtctcatctgttgattcactggagtgtaaggtaaaccttcaaggaaggattaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtt

SEQ ID NO: 147422 - DNA, 729 bp, Homo sapiens
  Payload ID: 9157
  Gene Symbol: LAMA4
  Gene Name: laminin, alpha 4
  ENST ID: ENST00000521732
  CDS Start-End: 1-562
aagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaagcactggaacaagccaagaagaagactggaattgcaggaaggagtataatgactcagaagacagtgtccattcagagagcccacagtttatgaagggactgatgaccacattgccgctgcacagtgggctctgtgactacaggagccttgctctgtagggaggggattacccttctccaataaaaagcctctgggcatgtgtttgttataatacca

SEQ ID NO: 147423 - DNA, 588 bp, Homo sapiens
  Payload ID: 9157
  Gene Symbol: LAMA4
  Gene Name: laminin, alpha 4
  ENST ID: ENST00000519932
  CDS Start-End: 269-588
aaaagctgaatattcttctggagcccttggaggggctccaaactgagaggggagggaagaccgcagggaaaggcggacctcagtgtctgaaaagccagcttagagtgggagggcctgggagtagaagctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacagg

SEQ ID NO: 147424 - DNA, 6438 bp, Homo sapiens
  Payload ID: 9157
  Gene Symbol: LAMA4
  Gene Name: laminin, alpha 4
  ENST ID: ENST00000522006
  CDS Start-End: 411-5861
ttcttctggagcccttggaggggctccaaactgagaggggagggaagaccgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactgtaagctccgtccatctctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaactatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcggtggccctgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttgtttttagcccttttgtttggtctatcagtataagaagaatattttaggtttatagctgaagttatcaaggtttaataaagtaaatttctaacagaatactagaaaaa

SEQ ID NO: 147425 - DNA, 1330 bp, Homo sapiens
  Payload ID: 9157
  Gene Symbol: LAMA4
  Gene Name: laminin, alpha 4
  ENST ID: ENST00000521398
  CDS Start-End: 336-1330
aatccgtctgccttttgatgccgtactgtaagctccgtccatctgtaggttcttgagccagaacctctgcgggaaggagaaaaagtgaaagagggagagggagagggagagagagggggagaaggggagagagagagagggagagagaggctggaactctcccttactctcgcactttccctttatttcctaagctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaata

SEQ ID NO: 147426 - DNA, 539 bp, Homo sapiens
  Payload ID: 9157
  Gene Symbol: LAMA4
  Gene Name: laminin, alpha 4
  ENST ID: ENST00000521690
  CDS Start-End: 296-539
gtctatcccccagaaaaaacccgagaaaccttgctcaagaaagtgggcaccctgaccctctgccttcagagatcatctacctttggttcctgccctggaatcccttttccacccactttcctgcaaactagcgggggccacataaaatatctatctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccct

SEQ ID NO: 147427 - DNA, 11426 bp, Homo sapiens
  Payload ID: 9158
  Gene Symbol: LAMA5
  Gene Name: laminin, alpha 5
  Uniprot ID: O15230
  ENST ID: ENST00000252999
  CDS Start-End: 68-11155
agacccgccgggctcccgccgcgcgcgctgtccctggagctcggggacgcggcccggagccgggaagatggcgaagcggctctgcgcggggagcgcactgtgtgttcgcggcccccggggccccgcgccgctgctgctggtcgggctggcgctgctgggcgcggcgcgggcgcgggaggaggcgggcggcggcttcagcctgcacccgccctacttcaacctggccgagggcgcccgcatcgccgcctccgcgacctgcggagaggaggccccggcgcgcggctccccgcgccccaccgaggacctttactgcaagctggtagggggccccgtggccggcggcgaccccaaccagaccatccggggccagtactgtgacatctgcacggctgccaacagcaacaaggcacaccccgcgagcaatgccatcgatggcacggagcgctggtggcagagtccaccgctgtcccgcggcctggagtacaacgaggtcaacgtcaccctggacctgggccaggtcttccacgtggcctacgtcctcatcaagtttgccaactcaccccggccggacctctgggtgctggagcggtccatggacttcggccgcacctaccagccctggcagttctttgcctcctccaagagggactgtctggagcggttcgggccacagacgctggagcgcatcacacgggacgacgcggccatctgcaccaccgagtactcacgcatcgtgcccctggagaacggagagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccaccggcgtcaactgtgagcgctgcctgcccggcttctaccgctctcccaaccaccctctcgactcgccccacgtctgccgccgctgcaactgcgagtccgacttcacggatggcacctgcgaggacctgacgggtcgatgctactgccggcccaacttctctggggagcggtgtgacgtgtgtgccgagggcttcacgggcttcccaagctgctacccgacgccctcgtcctccaatgacaccagggagcaggtgctgccagccggccagattgtgaattgtgactgcagcgcggcagggacccagggcaacgcctgccggaaggacccaagggtgggacgctgtctgtgcaaacccaacttccaaggcacccattgtgagctctgcgcgccagggttctacggccccggctgccagccctgccagtgttccagccctggagtggccgatgaccgctgtgaccctgacacaggccagtgcaggtgccgagtgggcttcgagggggccacatgtgatcgctgtgcccccggctactttcacttccctctctgccagttgtgtggctgcagccctgcaggaaccttgcccgagggctgcgatgaggccggccgctgcctatgccagcctgagtttgctggacctcattgtgaccggtgccgccctggctaccatggtttccccaactgccaagcatgcacctgcgaccctcggggagccctggaccagctctgtggggcgggaggtttgtgccgctgccgccccggctacacaggcactgcctgccaggaatgcagccccggctttcacggcttccccagctgtgtcccctgccactgctctgctgaaggctccctgcacgcagcctgtgacccccggagtgggcagtgcagctgccggccccgtgtgacggggctgcggtgtgacacatgtgtgcccggtgcctacaacttcccctactgcgaagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgcgcctggagctggaggaggctgccacacctgagggtcacgccgtgcgctttggcttcaaccccctcgagttcgagaacttcagctggaggggctacgcgcagatggcacctgtccagcccaggatcgtggccaggctgaacctgacctcccctgaccttttctggctcgtcttccgatacgtcaaccggggggccatgagtgtgagcgggcgggtctctgtgcgagaggagggcaggtcggccacctgcgccaactgcacagcacagagtcagcccgtggccttcccacccagcacggagcctgccttcatcaccgtgccccagaggggcttcggagagccctttgtgctgaaccctggcacctgggccctgcgtgtggaggccgaaggggtgctcctggactacgtggttctgctgcctagcgcatactacgaggcggcgctcctgcagctgcgggtgactgaggcctgcacataccgtccctctgcccagcagtctggcgacaactgcctcctctacacacacctccccctggatggcttcccctcggccgccgggctggaggccctgtgtcgccaggacaacagcctgccccggccctgccccacggagcagctcagcccgtcgcacccgccactgatcacctgcacgggcagtgatgtggacgtccagcttcaagtggcagtgccacagccaggccgctatgccctagtggtggagtacgccaatgaggatgcccgccaggaggtgggcgtggccgtgcacaccccacagcgggccccccagcaggggctgctctccctgcacccctgcctgtacagcaccctgtgccggggcactgcccgggatacccaggaccacctggctgtcttccacctggactcggaggccagcgtgaggctcacagccgaacaggcacgcttcttcctgcacggggtcactctggtgcccattgaggagttcagcccggagttcgtggagccccgggtcagctgcatcagcagccacggcgcctttggccccaacagtgccgcctgtctgccctcgcgcttcccaaagccgccccagcccatcatcctcagggactgccaggtgatcccgctgccgcccggcctcccgctgacccacgcgcaggatctcactccagccatgtccccagctggaccccgacctcggccccccaccgctgtggaccctgatgcagagcccaccctgctgcgtgagccccaggccaccgtggtcttcaccacccatgtgcccacgctgggccgctatgccttcctgctgcacggctaccagccagcccaccccaccttccccgtggaagtcctcatcaacgccggccgcgtgtggcagggccacgccaacgccagcttctgtccacatggctacggctgccgcaccctggtggtgtgtgagggccaggccctgctggacgtgacccacagcgagctcactgtgaccgtgcgtgtgcccaagggccggtggctctggctggattatgtactcgtggtccctgagaacgtctacagctttggctacctccgggaggagcccctggataaatcctatgacttcatcagccactgcgcagcccagggctaccacatcagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggccctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtgtcatcctacggtgggaccctccgttatgaactgcactcagagacccagcggggagatgtctttgtccccatggagagcaggccggatgtggtgctgcagggcaaccagatgagcatcacattcctggagccggcataccccacgcctggccacgttcaccgtgggcagctgcagctggtggaggggaacttccggcatacggagacgcgcaacactgtgtcccgcgaggagctcatgatggtgctggccagcctggagcagctgcagatccgtgccctcttctcacagatctcctcggctgtcttcctgcgcagggtggcactggaggtggccagcccagcaggccagggggccctggccagcaatgtggagctgtgcctgtgccccgccagctaccggggggactcatgccaggaatgtgcccccggcttctatcgggacgtcaaaggtctcttcctgggccgatgtgtcccttgtcagtgccatggacactcagaccgctgcctccctggctctggcgtctgtgtggactgccagcacaacaccgaaggggcccactgtgagcgctgccaggctggcttcgtgagcagcagggacgaccccagcgccccctgtgtcagctgcccctgccccctctcagtgccttccaacaacttcgccgagggctgtgtcctgcgaggcggccgcacccagtgcctctgcaaacctggttatgcaggtgcctcctgcgagcggtgtgcgcccggattctttgggaacccactggtgctgggcagctcctgccagccatgcgactgcagcggcaacggtgaccccaacttgctcttcagcgactgcgaccccctgacgggcgcctgccgtggctgcctgcgccacaccactgggccccgctgcgagatctgtgcccccggcttctacggcaacgccctgctgcccggcaactgcacccggtgcgactgtaccccatgtgggacagaggcctgcgacccccacagcgggcactgcctgtgcaaggcgggcgtgactgggcggcgctgtgaccgctgccaggagggacattttggtttcgatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgacggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgtttttatatttggcccttccacccatttttaattgtgagagatttgtcaccaatcatcactggttcctccttaaaaattaaaaagtaacttctgtgtaa

SEQ ID NO: 147428 - DNA, 579 bp, Homo sapiens
  Payload ID: 9158
  Gene Symbol: LAMA5
  Gene Name: laminin, alpha 5
  ENST ID: ENST00000474128
  CDS Start-End: 1-117
tgtgtgcccggtgcctacaacttcccctactgcgaaggtgctgtgtggtgggatggcacgtccgttgctgcggagggagcagggaggtgcgtgttttcaggccgtccatgtggatgagagctggctcttgccaccctgccggtctggccccagtggatcctgcccttcctgaggcacaggttccctgtatgtgccgggctcacgtggaggggccgagctgtgaccgctgcaaacctgggttctggggactgagccccagcaaccccgagggctgtacccgctgcagctgcgacctcaggggcacactgggtggagttgctgagtgccagccgggcaccggccagtgcttctgcaagccccacgtgtgcggccaggcctgcgcgtcctgcaaggatggcttctttggactggatcaggctgactattttggctgccgcagctgccggtgtgacattggcggtgcactgggccagagctgtgaaccgaggacgggcgtctgccggtgccgccccaacacccagggccccacctgcagcgagcctgcgagggaccactacctcccggacctgcaccacctgc

SEQ ID NO: 147429 - DNA, 723 bp, Homo sapiens
  Payload ID: 9158
  Gene Symbol: LAMA5
  Gene Name: laminin, alpha 5
  ENST ID: ENST00000497053
  CDS Start-End: 1-723
cgcctgcgcttcctgcgtaccaacacgctgctgggccatctcatggggaaggcgctgcgggaccccacggtcacccgccggtattattacagcatcaaggatatcagcatcggaggccgctgtgtctgccacggccacgcggatgcctgcgatgccaaagaccccacggacccgttcagctcccccaacctttcaggacacaacagacaacttccctgctgccccagccctgaccttcactccagtcaagcagggaccaaggcccaggacggggatggcagggtgggggcagccaacaccccacatctgctgtgccctgtgtgcctgctttcgggggcagccgagggcactgcagagcatccacctcccgggagcccctcacaggatgggcagcagccctggtgctggcaccggcacattcctgggcctcacccagagtcctcagtaaggctgcagtgcacctgccagcacaacacctgcgggggcacctgcgaccgctgctgccccggcttcaatcagcagccgtggaagcctgcgactgccaacagtgccaacgagtgccagtcctgtaactgctacggccatgccaccgactgttactacgaccctgaggtggaccggcgccgcgccagccagagcctggatggcacctatcagggtgggggtgtctgtatcgactgccagcaccacaccaccggcgtcaactgtgagcgctgcctgccc

SEQ ID NO: 147430 - DNA, 5725 bp, Homo sapiens
  Payload ID: 9159
  Gene Symbol: LAMB1
  Gene Name: laminin, beta 1
  Uniprot ID: P07942
  ENST ID: ENST00000222399
  CDS Start-End: 232-5592
ttgcggccgcccgccccttcagccccggctctccgtatgcgcatgagcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccagcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaacaaggtaaaacaactacattttaaaaactgacttaatgctcttcaaaataaaacatcacctatttaatgtttttaatcacattttgtatggagttaaataaag

SEQ ID NO: 147431 - DNA, 550 bp, Homo sapiens
  Payload ID: 9159
  Gene Symbol: LAMB1
  Gene Name: laminin, beta 1
  ENST ID: ENST00000393559
  CDS Start-End: 276-550
ttctttgggctcgggggctcccggagcagggcgagagctcgcgtcgccgggtgaggagaacaaagtggctgcacgattttccccactttccagcccaccccccgcttccgtgggagcgacaggaaatggaagggcgcctcttctctctttgaacatttgccttttttcccctcctttccacctctccagaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctga

SEQ ID NO: 147432 - DNA, 2806 bp, Homo sapiens
  Payload ID: 9159
  Gene Symbol: LAMB1
  Gene Name: laminin, beta 1
  ENST ID: ENST00000393560
  CDS Start-End: 164-2716
ctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaacgtaggttcctcaaaagcattgttatgcattcattcagattaactcagccattgtggcagggttccattgctgcagagccgatgcttccctcctgaagttgatcacaccaacccatgagcattctgaattggggacagggtgcttataaaaggagcatgtttccattgaatgagtttctcaaggca

SEQ ID NO: 147433 - DNA, 5766 bp, Homo sapiens
  Payload ID: 9159
  Gene Symbol: LAMB1
  Gene Name: laminin, beta 1
  ENST ID: ENST00000393561
  CDS Start-End: 186-5618
ggggctgatcagggtgggcgcgagcgtcggtgggtttcccgggagggaggctctcgctgctggacagacctgatgacgtgtgtgggtttctttccgtgtccttctcctttcggagtccctgccttcccagcctctcctgcgctcatctctccattgtcttttctgtgcattttgctttcttccgaatggactgtcctctctccgcacccactcccccgcccccgcttgttcgtttttttcgggctccactccctgcttgtgtccccccaactctgttgcctgtccttcccgcagccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgtaactatccaactggatttggaagcagaattccattttactcatctcataatgactttcaagacattccgtccagctgctatgctgatagaacgatcgtccgactttgggaaaacctggggtgtgtatagatacttcgcctatgactgtgaggcctcgtttccaggcatttcaactggccccatgaaaaaagtcgatgacataatttgtgattctcgatattctgacattgaaccctcaactgaaggagaggtgatatttcgtgctttagatcctgctttcaaaatagaagatccttatagcccaaggatacagaatttattaaaaattaccaacttgagaatcaagtttgtgaaactgcatactttgggagataaccttctggattccaggatggaaatcagagaaaagtattattatgcagtttatgatatggtggttcgaggaaattgcttctgctatggtcatgccagcgaatgtgcccctgtggatggattcaatgaagaagtggaaggaatggttcacggacactgcatgtgcaggcataacaccaagggcttaaactgtgaactctgcatggatttctaccatgatttaccttggagacctgctgaaggccgaaacagcaacgcctgtaaaaaatgtaactgcaatgaacattccatctcttgtcactttgacatggctgtttacctggccacggggaacgtcagcggaggcgtgtgtgatgactgtcagcacaacaccatggggcgcaactgtgagcagtgcaagccgttttactaccagcacccagagagggacatccgagatcctaatttctgtgaacgatgtacgtgtgacccagctggctctcaaaatgagggaatttgtgacagctatactgatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggagggaatccttgtgattccgagacaggtcactgctactgcaagcgtctggtgacaggacagcattgtgaccagtgcctgccagagcactggggcttaagcaatgatttggatggatgtcgaccatgtgactgtgaccttgggggagccttaaacaacagttgctttgcggagtcaggccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactggagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatgtggtaataccatccccgatgatgacaaccaggtggtgtcattatcaccaggctcaagatatgtcgtccttcctcggccggtgtgctttgagaagggaacaaactacacggtgaggttggagctgcctcagtacacctcctctgatagcgacgtggagagcccctacacgctgatcgattctcttgttctcatgccatactgtaaatcactggacatcttcaccgtgggaggttcaggagatggggtggtcaccaacagtgcctgggaaacctttcagagataccgatgtctagagaacagcagaagcgttgtgaaaacaccgatgacagatgtttgcagaaacatcatctttagcatttctgccctgttacaccagacaggcctggcttgtgaatgcgaccctcagggttcgttaagttccgtgtgtgatcccaacggaggccagtgccagtgccggcccaacgtggttggaagaacctgcaacagatgtgcacctggaacttttggctttggccccagtggatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctgctaccaagatcctgttactttacagcttgcctgtgtttgtgatcctggatacattggttccagatgtgacgactgtgcctcaggatactttggcaatccatcagaagttggggggtcgtgtcagccttgccagtgtcacaacaacattgacacgacagacccagaagcctgtgacaaggagactgggaggtgtctcaagtgcctgtaccacacggaaggggaacactgtcagttctgccggtttggatactatggtgatgccctccagcaggactgtcgaaagtgtgtctgtaattacctgggcaccgtgcaagagcactgtaacggctctgactgccagtgcgacaaagccactggtcagtgcttgtgtcttcctaatgtgatcgggcagaactgtgaccgctgtgcgcccaatacctggcagctggccagtggcactggctgtgacccatgcaactgcaatgctgctcattccttcgggccatcttgcaatgagttcacggggcagtgccagtgcatgcctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggtggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccaccacagaacccaacagcactgtggagcagtcagccctcatgagagacagagtagaagacgtgatgatggagcgagaatcccagttcaaggaaaaacaagaggagcaggctcgcctccttgatgaactggcaggcaagctacaaagcctagacctttcagccgctgccgaaatgacctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgctgaagacattctgttgaagacaaatgctaccaaagaaaaaatggacaagagcaatgaggagctgagaaatctaatcaagcaaatcagaaactttttgacccaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaacaaggtaaaacaactacattttaaaaactgacttaatgctcttcaaaataaaacatcacctatttaatgtttttaatcacattttgtatggagttaaataaagtacagtgcttttgta

SEQ ID NO: 147434 - DNA, 703 bp, Homo sapiens
  Payload ID: 9159
  Gene Symbol: LAMB1
  Gene Name: laminin, beta 1
  ENST ID: ENST00000439976
  CDS Start-End: 153-703
aaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctccagttgctagctttcagtttcttagaaacagcaggacctggcgcttccctggaatggagaagccttgaaaccactccagagccccagggactgtccatgggctcccctagctccggaaagcggcgtccaccgcgagccccggcgcctcgtccccagcgaagcgccggtgaccctcgcgcgtgcacgcacacgcactctcgcttcccaagctcacagatctccacgcgcacactcacaccgaggatgcgcgggctgccgcgtgcacgcgggttcacgtgcgtggccctgtgcagagcccgagtgcgcgctcaggaacccgagttcagctacggctgcgcagaaggcagctgctatcccgccacgggcgaccttctcatcggccgagcacagaagctttcggtgacctcgacgtgcgggctgcacaagcccgaaccctactgtatcgtcagccacttgcaggaggacaaaaaatgcttcatatgcaattcccaagatccttatcatgagaccctgaatcctgacagccatctcattgaaaa

SEQ ID NO: 147435 - DNA, 5643 bp, Homo sapiens
  Payload ID: 9160
  Gene Symbol: LAMB2
  Gene Name: laminin, beta 2 (laminin S)
  Uniprot ID: P55268
  ENST ID: ENST00000305544
  CDS Start-End: 154-5550
agggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaat

SEQ ID NO: 147436 - DNA, 5674 bp, Homo sapiens
  Payload ID: 9160
  Gene Symbol: LAMB2
  Gene Name: laminin, beta 2 (laminin S)
  Uniprot ID: P55268
  ENST ID: ENST00000418109
  CDS Start-End: 166-5562
ccgcccggtgttgcgctccttcccagaatccgctccggcctttccttcctgccgcgattcccaactttgctcaaagtcgctggactctaagctgtcggagggaccgctggacagacctgggaactgacagagggcctggagggaaacaggccaaagacccacaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaaccccca

SEQ ID NO: 147437 - DNA, 582 bp, Homo sapiens
  Payload ID: 9160
  Gene Symbol: LAMB2
  Gene Name: laminin, beta 2 (laminin S)
  ENST ID: ENST00000494831
  CDS Start-End: 130-582
aactttgctcaaagtcgctggactctaagctgtcggagggaccgctggacagacctgggaactgacagagggcctggagggaaacaggccaaagacccacaggctgagtttcatttcacacacctcattatgaccttcaagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcc

SEQ ID NO: 147438 - DNA, 4055 bp, Homo sapiens
  Payload ID: 9161
  Gene Symbol: LAMB3
  Gene Name: laminin, beta 3
  Uniprot ID: Q13751
  ENST ID: ENST00000356082
  CDS Start-End: 136-3654
ggctgttgtttaaaaacctggagccgggaggggagacccccacattcaagaggagctttcaggcgatctggagaaagaacggcagaacacacagcaaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcacagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgtaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttggaaaagagcctggaggttcaacgaggaaaaa

SEQ ID NO: 147439 - DNA, 3931 bp, Homo sapiens
  Payload ID: 9161
  Gene Symbol: LAMB3
  Gene Name: laminin, beta 3
  Uniprot ID: Q13751
  ENST ID: ENST00000367030
  CDS Start-End: 119-3637
gcgggaggaggactgtatctctggatgcctggggcctggtttcagggcctgatttattcctcttcctgggagctcactcaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcacagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgtaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccac

SEQ ID NO: 147440 - DNA, 4305 bp, Homo sapiens
  Payload ID: 9161
  Gene Symbol: LAMB3
  Gene Name: laminin, beta 3
  Uniprot ID: Q13751
  ENST ID: ENST00000391911
  CDS Start-End: 391-3909
cttttctcctgcaaagggtccagccttttcctgctccccacgttgtccttacggctgtgtggggtagggcagggtccacactccttcccatccattttagaggaggaagctggagtctgggaagggatgggattttcccagggcaccctgtgagtcacatgccacttgagacaagggtctagagctccagcattttccaagctacaaatgtatctgctgctccaagtgtcctagatcaggaccctaggtaaagacttctgaaaaatacttgagtctagaaacagaaaagaaaaagggctagtgtgctctaggggtttgcactgttgtacccagtttgctttgctgtgtcctaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcacagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgtaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttggaaaagagcctggaggttcaacgagg

SEQ ID NO: 147441 - DNA, 908 bp, Homo sapiens
  Payload ID: 9161
  Gene Symbol: LAMB3
  Gene Name: laminin, beta 3
  ENST ID: ENST00000415782
  CDS Start-End: 345-908
ccctgagaaaagccagccctctctcttggggctggaactaggtcttggccctttctacagcttttctcctgcaaagggtccagccttttcctgctccccacgttgtccttacggctgtgtggggtagggcagggtccacactccttcccatccattttagaggaggaagctggagtctgggaagggatgggattttcccagggcaccctgtgagtcacatgccacttgagacaagggtctagagctccagcattttccaagctacaaatgtatctgctgctccaagtgtcctagatcaggaccctaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcacagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaag

SEQ ID NO: 147442 - DNA, 710 bp, Homo sapiens
  Payload ID: 9161
  Gene Symbol: LAMB3
  Gene Name: laminin, beta 3
  ENST ID: ENST00000455193
  CDS Start-End: 232-710
agggggcagcagctccttgggacaccacggtagaggggccactgtgggtgccttccacaagtgctgctcagctaggagaggcctcgtatctctggggaggttagtgggctcctacagtcaaatgcgtgttgtcttccagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccg

SEQ ID NO: 147443 - DNA, 5857 bp, Homo sapiens
  Payload ID: 9162
  Gene Symbol: LAMB4
  Gene Name: laminin, beta 4
  Uniprot ID: A4D0S4
  ENST ID: ENST00000205386
  CDS Start-End: 81-5366
acatgccccgtttgctgcctgaacctctccacaaagactcccagatcctgaattgaatttaatcatctcctgacaaaagaatgcaatttcaactgaccctttttttgcaccttgggtggctcagttactcaaaagctcaagatgactgcaacaggggtgcctgtcatcccaccactggtgatctcctggtgggcaggaacacgcagcttatggcttcttctacctgtgggctgagcagagcccagaaatactgcatcctcagttacctggagggggaacaaaaatgcttcatctgtgactctagatttccatatgatccgtatgaccaacccaacagccacaccattgagaatgtcattgtaagttttgaaccagacagagaaaagaaatggtggcaatctgaaaatggtcttgatcatgtcagcatcagactggacttagaggcattatttcggttcagccaccttatcctgacctttaagacttttcggcctgctgcaatgttagttgaacgttccacagactatggacacaactggaaagtgttcaaatattttgcaaaagactgtgccacttcctttcctaacatcacatctggccaggcccagggagtgggagacattgtttgtgactccaaatactcggatattgaaccctcaacaggtggagaggttgttttaaaagttttggatcccagttttgaaattgaaaacccttatagcccctacatccaagaccttgtgacattgacaaacctgaggataaactttaccaagctccacacccttggggatgctttgcttggaaggaggcaaaatgattcccttgataaatactactatgctctgtacgagatgattgttcggggaagctgcttttgcaatggccatgctagcgaatgtcgccctatgcagaagatgcggggagatgttttcagccctcctggaatggttcacggtcagtgtgtgtgtcagcacaatacagatggtccgaactgtgagagatgcaaggacttcttccaggatgctccttggaggccagctgcagacctccaggacaacgcttgcagatcgtgcagctgtaatagccactccagccgctgtcactttgacatgactacgtacctggcaagcggtggcctcagcgggggcgtgtgtgaagactgccagcacaacactgaggggcagcactgcgaccgctgcagacccctcttctacagggacccgctcaagaccatctcagatccctacgcgtgcattccttgtgaatgtgaccccgatgggaccatatctggtggcatttgtgtgagccactctgatcctgccttagggtctgtggccggccagtgcctttgtaaagagaacgtggaaggagccaaatgcgaccagtgcaaacccaaccactacggactaagcgccaccgaccccctgggctgccagccctgcgactgtaacccccttgggagtctgccattcttgacctgtgatgtggatacaggccaatgcttgtgcctgtcatatgtcaccggagcacactgcgaagaatgcactgttggatactggggcctgggaaatcatctccatgggtgttctccctgtgactgtgatattggaggtgcttattctaacgtgtgctcacccaagaatgggcagtgtgaatgccgcccacatgtcactggccgtagctgctctgaaccagcccctggctacttctttgctcctttgaatttctatctctacgaggcagaggaagccacaacactccaaggactggcgcctttgggctcggagacgtttggccagagtcctgctgttcacgttgttttaggagagccagttcctgggaaccctgttacatggactggacctggatttgccagggttctccctggggctggcttgagatttgctgtcaacaacattccctttcctgtggacttcaccattgccattcactatgaaacccagtctgcagctgactggactgtccagattgtggtgaacccccctggagggagtgagcactgcatacccaagactctacagtcaaagcctcagtcttttgccttaccagcggctacgagaatcatgctgcttcccacacccatctgtttagaaccagatgtacaatattccatagatgtctatttttctcagcctttgcaaggagagtcccacgctcattcacatgtcctggtggactctcttggccttattccccaaatcaattcattggagaatttctgcagcaagcaggacttagatgagtatcagcttcacaactgtgttgaaattgcctcagcaatgggacctcaagtgctcccgggtgcctgtgaaaggctgatcatcagcatgtctgccaagctgcatgatggggctgtggcctgcaagtgtcacccccagggctcagtcggatccagctgcagccgacttggaggccagtgccagtgtaaacctcttgtggtcgggcgctgctgtgacaggtgctcaactggaagctatgatttggggcatcacggctgtcacccatgtcactgccatcctcaaggatcaaaggacactgtatgtgaccaagtaacaggacagtgcccctgccatggagaggtgtctggccgccgctgtgatcgctgcctggcaggctactttggatttcccagctgccacccttgcccttgtaataggtttgctgaactttgtgatcctgagacagggtcatgcttcaattgtggaggctttacaactggcagaaactgtgaaaggtgtattgatggttactatggaaatccttcttcaggacagccctgtcgtccttgcctgtgtccagatgatccctcaagcaatcagtattttgcccattcctgttatcagaatctgtggagctcagatgtaatctgcaattgtcttcaaggttatacgggtactcagtgtggagaatgctctactggtttctatggaaatccaagaatttcaggagcaccttgccaaccatgtgcctgcaacaacaacatagatgtaaccgatccagagtcctgcagccgggtaacaggggagtgccttcgatgtttgcacaacactcagggcgcaaactgccagctctgcaaaccaggtcactatggatcagccctcaatcagacctgcagaagatgctcctgccatgcttccggcgtgagtcccatggagtgtccccctggtgggggagcttgcctctgtgaccctgtcactggtgcatgtccttgtctgccgaatgtcacaggcctggcctgtgaccgttgtgctgatggatactggaatctggtccctggcagaggatgtcagtcatgtgactgtgaccctaggacctctcaaagtagccactgtgaccagcttacaggccagtgtccgtgtaaattaggttacggcgggaaacgttgcagtgagtgccaggaaaattattatggtgatccacctgggcgatgcattccatgtgattgtaacagggcaggtacccagaagcccatctgtgatccagacacaggcatgtgccgctgccgggagggtgtcagcggccagagatgtgatcgctgtgcccggggacacagccaggaattccctacttgtcttcaatgtcacttgtgctttgatcagtgggaccacaccatttcttccctctccaaagcggtgcaagggttaatgagactggctgctaacatggaagataaaagagagaccctgcctgtctgtgaggcagacttcaaagacctcagagggaacgtgtctgaaatagaaaggattttgaaacatcctgttttcccatctgggaaattcttaaaagtcaaggattatcatgactctgttagaagacaaatcatgcagctaaatgaacaactgaaagcagtgtatgaatttcaagatctgaaagatacaatagaaagagcaaagaatgaagcagacctcttacttgaagaccttcaggaagaaattgatttgcaatccagtgtccttaatgcaagcattgcggactcctcagaaaacatcaagaaatattatcacatatcatcatctgctgaaaagaaaattaatgaaactagttccaccattaatacctctgcaaatacaaggaatgacttacttaccatcttagatacactaacctcaaaaggaaacttgtcattggaaagattaaagcagattaagataccagatatccaaatattgaatgaaaaggtgtgcggagatccaggaaatgtgccatgtgtgcccttgccctgtggcggtgctctctgcacgggccggaaggggcacaggaagtgtaggggtcccggctgtcacggctccctgaccctctcaacgaatgccctccaaaaagcccaggaagcaaaatccattattcgtaatttggacaaacaggttcgtgggttgaaaaatcagatcgaaagtataagtgaacaggcagaagtctccaaaaacaatgccttacagctgagggaaaaactgggaaatataagaaaccaaagtgactctgaagaagaaaacatcaatcttttcatcaaaaaagtgaaaaactttttgttagaggaaaacgtgcctccagaagacatcgagaaggttgcgaatggtgtgcttgacattcacctaccaattccatcccaaaatctaaccgatgaacttgtcaaaatacagaaacatatgcaactctgtgaggattacaggacagatgaaaacaggttaaatgaagaagcagatggagcccaaaagcttttggtgaaggccaaagcagctgagaaagcagcaaatattctattaaatcttgacaaaacattgaaccagttacaacaagctcaaatcactcaaggacgggcaaactctaccattacacagctgactgccaatataacaaaaataaaaaagaatgtgctgcaggctgaaaatcaaaccagggaaatgaagagtgagctggagttagcaaagcagcgatcagggctggaggatggactttccctgctgcagaccaagttgcaaaggcatcaagaccacgctgtcaatgcgaaagttcaggctgaatctgcccaacaccaggctgggagtcttgagaaggaatttgttgagctgaaaaaacaatatgctattctccaacgtaagacaagcactacaggactaacaaaggagacattaggaaaagttaaacagctaaaagatgcggcagaaaaattggctggagatacagaggccaagataagaagaataacagatttagaaaggaaaatccaagatttgaatctaagtagacaagcaaaagctgatcaactgagaatattggaagatcaagttgttgccattaaaaatgaaattgttgaacaagaaaaaaaatatgctaggtgctatagctaggcagagttaaagagcaaaagcttgtgcctttgtttctggtttctgatgtacaagcccctggggctctgttgaacctgtgaaatactgacaatgtcttctaccttccttccccacaccctgtccttattagacacctgctcagtgtggctggaggttgaaatgccaccaggaaaatgccacttcataattgaaaggggaaagtaatgaaattgtctctggtttcagaaacttttcctcttaccttcctttctctttcctaacttaaaaataacagtttccatataacaagtagaaatttaagtaagtactctactaactaataatcatttcagtcagataaacctaaacattaaataaatatctccaatattaggatggaatacatatgtatggcatgtactagattgtcctatattttatgtttatttggatttgcttttatttgtaaaattattcttttctgaataaactgcatacaattcaaaatgcaa

SEQ ID NO: 147444 - DNA, 5858 bp, Homo sapiens
  Payload ID: 9162
  Gene Symbol: LAMB4
  Gene Name: laminin, beta 4
  Uniprot ID: A4D0S4
  ENST ID: ENST00000388781
  CDS Start-End: 85-5370
cacatgccccgtttgctgcctgaacctctccacaaagactcccagatcctgtagaattgaatttaatcatctcctgacaaaagaatgcaatttcaactgaccctttttttgcaccttgggtggctcagttactcaaaagctcaagatgactgcaacaggggtgcctgtcatcccaccactggtgatctcctggtgggcaggaacacgcagcttatggcttcttctacctgtgggctgagcagagcccagaaatactgcatcctcagttacctggagggggaacaaaaatgcttcatctgtgactctagatttccatatgatccgtatgaccaacccaacagccacaccattgagaatgtcattgtaagttttgaaccagacagagaaaagaaatggtggcaatctgaaaatggtcttgatcatgtcagcatcagactggacttagaggcattatttcggttcagccaccttatcctgacctttaagacttttcggcctgctgcaatgttagttgaacgttccacagactatggacacaactggaaagtgttcaaatattttgcaaaagactgtgccacttcctttcctaacatcacatctggccaggcccagggagtgggagacattgtttgtgactccaaatactcggatattgaaccctcaacaggtggagaggttgttttaaaagttttggatcccagttttgaaattgaaaacccttatagcccctacatccaagaccttgtgacattgacaaacctgaggataaactttaccaagctccacacccttggggatgctttgcttggaaggaggcaaaatgattcccttgataaatactactatgctctgtacgagatgattgttcggggaagctgcttttgcaatggccatgctagcgaatgtcgccctatgcagaagatgcggggagatgttttcagccctcctggaatggttcacggtcagtgtgtgtgtcagcacaatacagatggtccgaactgtgagagatgcaaggacttcttccaggatgctccttggaggccagctgcagacctccaggacaacgcttgcagatcgtgcagctgtaatagccactccagccgctgtcactttgacatgactacgtacctggcaagcggtggcctcagcgggggcgtgtgtgaagactgccagcacaacactgaggggcagcactgcgaccgctgcagacccctcttctacagggacccgctcaagaccatctcagatccctacgcgtgcattccttgtgaatgtgaccccgatgggaccatatctggtggcatttgtgtgagccactctgatcctgccttagggtctgtggccggccagtgcctttgtaaagagaacgtggaaggagccaaatgcgaccagtgcaaacccaaccactacggactaagcgccaccgaccccctgggctgccagccctgcgactgtaacccccttgggagtctgccattcttgacctgtgatgtggatacaggccaatgcttgtgcctgtcatatgtcaccggagcacactgcgaagaatgcactgttggatactggggcctgggaaatcatctccatgggtgttctccctgtgactgtgatattggaggtgcttattctaacgtgtgctcacccaagaatgggcagtgtgaatgccgcccacatgtcactggccgtagctgctctgaaccagcccctggctacttctttgctcctttgaatttctatctctacgaggcagaggaagccacaacactccaaggactggcgcctttgggctcggagacgtttggccagagtcctgctgttcacgttgttttaggagagccagttcctgggaaccctgttacatggactggacctggatttgccagggttctccctggggctggcttgagatttgctgtcaacaacattccctttcctgtggacttcaccattgccattcactatgaaacccagtctgcagctgactggactgtccagattgtggtgaacccccctggagggagtgagcactgcatacccaagactctacagtcaaagcctcagtcttttgccttaccagcggctacgagaatcatgctgcttcccacacccatctgtttagaaccagatgtacaatattccatagatgtctatttttctcagcctttgcaaggagagtcccacgctcattcacatgtcctggtggactctcttggccttattccccaaatcaattcattggagaatttctgcagcaagcaggacttagatgagtatcagcttcacaactgtgttgaaattgcctcagcaatgggacctcaagtgctcccgggtgcctgtgaaaggctgatcatcagcatgtctgccaagctgcatgatggggctgtggcctgcaagtgtcacccccagggctcagtcggatccagctgcagccgacttggaggccagtgccagtgtaaacctcttgtggtcgggcgctgctgtgacaggtgctcaactggaagctatgatttggggcatcacggctgtcacccatgtcactgccatcctcaaggatcaaaggacactgtatgtgaccaagtaacaggacagtgcccctgccatggagaggtgtctggccgccgctgtgatcgctgcctggcaggctactttggatttcccagctgccacccttgcccttgtaataggtttgctgaactttgtgatcctgagacagggtcatgcttcaattgtggaggctttacaactggcagaaactgtgaaaggtgtattgatggttactatggaaatccttcttcaggacagccctgtcgtccttgcctgtgtccagatgatccctcaagcaatcagtattttgcccattcctgttatcagaatctgtggagctcagatgtaatctgcaattgtcttcaaggttatacgggtactcagtgtggagaatgctctactggtttctatggaaatccaagaatttcaggagcaccttgccaaccatgtgcctgcaacaacaacatagatgtaaccgatccagagtcctgcagccgggtaacaggggagtgccttcgatgtttgcacaacactcagggcgcaaactgccagctctgcaaaccaggtcactatggatcagccctcaatcagacctgcagaagatgctcctgccatgcttccggcgtgagtcccatggagtgtccccctggtgggggagcttgcctctgtgaccctgtcactggtgcatgtccttgtctgccgaatgtcacaggcctggcctgtgaccgttgtgctgatggatactggaatctggtccctggcagaggatgtcagtcatgtgactgtgaccctaggacctctcaaagtagccactgtgaccagcttacaggccagtgtccgtgtaaattaggttacggcgggaaacgttgcagtgagtgccaggaaaattattatggtgatccacctgggcgatgcattccatgtgattgtaacagggcaggtacccagaagcccatctgtgatccagacacaggcatgtgccgctgccgggagggtgtcagcggccagagatgtgatcgctgtgcccggggacacagccaggaattccctacttgtcttcaatgtcacttgtgctttgatcagtgggaccacaccatttcttccctctccaaagcggtgcaagggttaatgagactggctgctaacatggaagataaaagagagaccctgcctgtctgtgaggcagacttcaaagacctcagagggaacgtgtctgaaatagaaaggattttgaaacatcctgttttcccatctgggaaattcttaaaagtcaaggattatcatgactctgttagaagacaaatcatgcagctaaatgaacaactgaaagcagtgtatgaatttcaagatctgaaagatacaatagaaagagcaaagaatgaagcagacctcttacttgaagaccttcaggaagaaattgatttgcaatccagtgtccttaatgcaagcattgcggactcctcagaaaacatcaagaaatattatcacatatcatcatctgctgaaaagaaaattaatgaaactagttccaccattaatacctctgcaaatacaaggaatgacttacttaccatcttagatacactaacctcaaaaggaaacttgtcattggaaagattaaagcagattaagataccagatatccaaatattgaatgaaaaggtgtgcggagatccaggaaatgtgccatgtgtgcccttgccctgtggcggtgctctctgcacgggccggaaggggcacaggaagtgtaggggtcccggctgtcacggctccctgaccctctcaacgaatgccctccaaaaagcccaggaagcaaaatccattattcgtaatttggacaaacaggttcgtgggttgaaaaatcagatcgaaagtataagtgaacaggcagaagtctccaaaaacaatgccttacagctgagggaaaaactgggaaatataagaaaccaaagtgactctgaagaagaaaacatcaatcttttcatcaaaaaagtgaaaaactttttgttagaggaaaacgtgcctccagaagacatcgagaaggttgcgaatggtgtgcttgacattcacctaccaattccatcccaaaatctaaccgatgaacttgtcaaaatacagaaacatatgcaactctgtgaggattacaggacagatgaaaacaggttaaatgaagaagcagatggagcccaaaagcttttggtgaaggccaaagcagctgagaaagcagcaaatattctattaaatcttgacaaaacattgaaccagttacaacaagctcaaatcactcaaggacgggcaaactctaccattacacagctgactgccaatataacaaaaataaaaaagaatgtgctgcaggctgaaaatcaaaccagggaaatgaagagtgagctggagttagcaaagcagcgatcagggctggaggatggactttccctgctgcagaccaagttgcaaaggcatcaagaccacgctgtcaatgcgaaagttcaggctgaatctgcccaacaccaggctgggagtcttgagaaggaatttgttgagctgaaaaaacaatatgctattctccaacgtaagacaagcactacaggactaacaaaggagacattaggaaaagttaaacagctaaaagatgcggcagaaaaattggctggagatacagaggccaagataagaagaataacagatttagaaaggaaaatccaagatttgaatctaagtagacaagcaaaagctgatcaactgagaatattggaagatcaagttgttgccattaaaaatgaaattgttgaacaagaaaaaaaatatgctaggtgctatagctaggcagagttaaagagcaaaagcttgtgcctttgtttctggtttctgatgtacaagcccctggggctctgttgaacctgtgaaatactgacaatgtcttctaccttccttccccacaccctgtccttattagacacctgctcagtgtggctggaggttgaaatgccaccaggaaaatgccacttcataattgaaaggggaaagtaatgaaattgtctctggtttcagaaacttttcctcttaccttcctttctctttcctaacttaaaaataacagtttccatataacaagtagaaatttaagtaagtactctactaactaataatcatttcagtcagataaacctaaacattaaataaatatctccaatattaggatggaatacatatgtatggcatgtactagattgtcctatattttatgtttatttggatttgcttttatttgtaaaattattcttttctgaataaactgcatacaattcaaaatg

SEQ ID NO: 147445 - DNA, 2600 bp, Homo sapiens
  Payload ID: 9162
  Gene Symbol: LAMB4
  Gene Name: laminin, beta 4
  ENST ID: ENST00000418464
  CDS Start-End: 81-2399
acatgccccgtttgctgcctgaacctctccacaaagactcccagatcctgaattgaatttaatcatctcctgacaaaagaatgcaatttcaactgaccctttttttgcaccttgggtggctcagttactcaaaagctcaagatgactgcaacaggggtgcctgtcatcccaccactggtgatctcctggtgggcaggaacacgcagcttatggcttcttctacctgtgggctgagcagagcccagaaatactgcatcctcagttacctggagggggaacaaaaatgcttcatctgtgactctagatttccatatgatccgtatgaccaacccaacagccacaccattgagaatgtcattgtaagttttgaaccagacagagaaaagaaatggtggcaatctgaaaatggtcttgatcatgtcagcatcagactggacttagaggcattatttcggttcagccaccttatcctgacctttaagacttttcggcctgctgcaatgttagttgaacgttccacagactatggacacaactggaaagtgttcaaatattttgcaaaagactgtgccacttcctttcctaacatcacatctggccaggcccagggagtgggagacattgtttgtgactccaaatactcggatattgaaccctcaacaggtggagaggttgttttaaaagttttggatcccagttttgaaattgaaaacccttatagcccctacatccaagaccttgtgacattgacaaacctgaggataaactttaccaagctccacacccttggggatgctttgcttggaaggaggcaaaatgattcccttgataaatactactatgctctgtacgagatgattgttcggggaagctgcttttgcaatggccatgctagcgaatgtcgccctatgcagaagatgcggggagatgttttcagccctcctggaatggttcacggtcagtgtgtgtgtcagcacaatacagatggtccgaactgtgagagatgcaaggacttcttccaggatgctccttggaggccagctgcagacctccaggacaacgcttgcagatcgtgcagctgtaatagccactccagccgctgtcactttgacatgactacgtacctggcaagcggtggcctcagcgggggcgtgtgtgaagactgccagcacaacactgaggggcagcactgcgaccgctgcagacccctcttctacagggacccgctcaagaccatctcagatccctacgcgtgcattccttgtgaatgtgaccccgatgggaccatatctggtggcatttgtgtgagccactctgatcctgccttagggtctgtggccggccagtgcctttgtaaagagaacgtggaaggagccaaatgcgaccagtgcaaacccaaccactacggactaagcgccaccgaccccctgggctgccagccctgcgactgtaacccccttgggagtctgccattcttgacctgtgatgtggatacaggccaatgcttgtgcctgtcatatgtcaccggagcacactgcgaagaatgcactgttggatactggggcctgggaaatcatctccatgggtgttctccctgtgactgtgatattggaggtgcttattctaacgtgtgctcacccaagaatgggcagtgtgaatgccgcccacatgtcactggccgtagctgctctgaaccagcccctggctacttctttgctcctttgaatttctatctctacgaggcagaggaagccacaacactccaaggactggcgcctttgggctcggagacgtttggccagagtcctgctgttcacgttgttttaggagagccagttcctgggaaccctgttacatggactggacctggatttgccagggttctccctggggctggcttgagatttgctgtcaacaacattccctttcctgtggacttcaccattgccattcactatgaaacccagtctgcagctgactggactgtccagattgtggtgaacccccctggagggagtgagcactgcatacccaagactctacagtcaaagcctcagtcttttgccttaccagcggctacgagaatcatgctgcttcccacacccatctgtttagaaccagatgtacaatattccatagatgtctatttttctcagcctttgcaaggagagtcccacgctcattcacatgtcctggtggactctgctgcagtgcagtggcacaatctcggctcactgcaacctccgcctcctgagtgcaagcaattctcctgcttcagcttcccgagtagctgggattacaggcacccgccaccacacctggctaatttttgtatttttagtagagatggggtttcaccacattggccaggctggtctcaaactcctgacctcaggtgatccacctgcctcagcctcccaaagtgctgggattacaggcatgagccacaatgcccagcctccccaattaatttttaagatcattagtacagtatgaaggtaccagtttcatcccaccttcaacagaattatatagaattgtgtgggatttttaaaaagtaatttcatggataaaaataaaatttctttgttaaaattgca

SEQ ID NO: 147446 - DNA, 2579 bp, Homo sapiens
  Payload ID: 9162
  Gene Symbol: LAMB4
  Gene Name: laminin, beta 4
  ENST ID: ENST00000422975
  CDS Start-End: 1-2250
aacatagatgtaaccgatccagagtcctgcagccgggtaacaggggagtgccttcgatgtttgcacaacactcagggcgcaaactgccagctctgcaaaccaggtcactatggatcagccctcaatcagacctgcagaagatgctcctgccatgcttccggcgtgagtcccatggagtgtccccctggtgggggagcttgcctctgtgaccctgtcactggtgcatgtccttgtctgccgaatgtcacaggcctggcctgtgaccgttgtgctgatggatactggaatctggtccctggcagaggatgtcagtcatgtgactgtgaccctaggacctctcaaagtagccactgtgaccagcttacaggccagtgtccgtgtaaattaggttacggcgggaaacgttgcagtgagtgccaggaaaattattatggtgatccacctgggcgatgcattccatgtgattgtaacagggcaggtacccagaagcccatctgtgatccagacacaggcatgtgccgctgccgggagggtgtcagcggccagagatgtgatcgctgtgcccggggacacagccaggaattccctacttgtcttcaatgtcacttgtgctttgatcagtgggaccacaccatttcttccctctccaaagcggtgcaagggttaatgagactggctgctaacatggaagataaaagagagaccctgcctgtctgtgaggcagacttcaaagacctcagagggaacgtgtctgaaatagaaaggattttgaaacatcctgttttcccatctgggaaattcttaaaagtcaaggattatcatgactctgttagaagacaaatcatgcagctaaatgaacaactgaaagcagtgtatgaatttcaagatctgaaagatacaatagaaagagcaaagaatgaagcagacctcttacttgaagaccttcaggaagaaattgatttgcaatccagtgtccttaatgcaagcattgcggactcctcagaaaacatcaagaaatattatcacatatcatcatctgctgaaaagaaaattaatgaaactagttccaccattaatacctctgcaaatacaaggaatgacttacttaccatcttagatacactaacctcaaaaggaaacttgtcattggaaagattaaagcagattaagataccagatatccaaatattgaatgaaaaggtgtgcggagatccaggaaatgtgccatgtgtgcccttgccctgtggcggtgctctctgcacgggccggaaggggcacaggaagtgtaggggtcccggctgtcacggctccctgaccctctcaacgaatgccctccaaaaagcccaggaagcaaaatccattattcgtaatttggacaaacaggttcgtgggttgaaaaatcagatcgaaagtataagtgaacaggcagaagtctccaaaaacaatgccttacagctgagggaaaaactgggaaatataagaaaccaaagtgactctgaagaagaaaacatcaatcttttcatcaaaaaagtgaaaaactttttgttagaggaaaacgtgcctccagaagacatcgagaaggttgcgaatggtgtgcttgacattcacctaccaattccatcccaaaatctaaccgatgaacttgtcaaaatacagaaacatatgcaactctgtgaggattacaggacagatgaaaacaggttaaatgaagaagcagatggagcccaaaagcttttggtgaaggccaaagcagctgagaaagcagcaaatattctattaaatcttgacaaaacattgaaccagttacaacaagctcaaatcactcaaggacgggcaaactctaccattacacagctgactgccaatataacaaaaataaaaaagaatgtgctgcaggctgaaaatcaaaccagggaaatgaagagtgagctggagttagcaaagcagcgatcagggctggaggatggactttccctgctgcagaccaagttgcaaaggcatcaagaccacgctgtcaatgcgaaagttcaggctgaatctgcccaacaccaggctgggagtcttgagaaggaatttgttgagctgaaaaaacaatatgctattctccaacgtaagacaagcactacaggactaacaaaggagacattaggaaaagttaaacagctaaaagatgcggcagaaaaattggctggagatacagaggccaagataagaagaataacaggctgttttcagaactcagcaagatagaaaaatgagacattgatttggctgtcttccccatgctgccacttgagaaggggcggaaccacaaggctgtgcctgttcctctctgttaggaagaggagcccctggatcccagtatggagcccttggcagcaacaatgttgagagagtggggaatggactctagtcttcagccagggtccttccacagaacttggtgtcagtcggggtcccagcaagaaacagaaagcatgcgtgggcataattttggataaagtatttagaagtggagttgtctcagtcatttattcactgcataataaattaccccaaaatgtaatggcttaaaataa

SEQ ID NO: 147447 - DNA, 7889 bp, Homo sapiens
  Payload ID: 9163
  Gene Symbol: LAMC1
  Gene Name: laminin, gamma 1 (formerly LAMB2)
  Uniprot ID: P11047
  ENST ID: ENST00000258341
  CDS Start-End: 258-5087
gtgcaggctgctcccggggtaggtgagggaagcgcggaggcggcgcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgccttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccagaccatgctggccggggtgcagtaccccagctccatcaacctcacgctgcacctgggaaaagcttttgacatcacctatgtgcgtctcaagttccacaccagccgcccggagagctttgccatttacaagcgcacacgggaagacgggccctggattccttaccagtactacagtggttcctgtgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgccctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggctctctaagcacacagtgtgatagttacggcagatgcagctgtaagccaggagtgatgggggacaaatgtgaccgttgccagcctggattccattctctcactgaagcaggatgcaggccatgctcttgtgatccctctggcagcatagatgaatgtaatattgaaacaggaagatgtgtttgcaaagacaatgtcgaaggcttcaattgtgaaagatgcaaacctggattttttaatctggaatcatctaatcctcggggttgcacaccctgcttctgctttgggcattcttctgtctgtacaaacgctgttggctacagtgtttattctatctcctctacctttcagattgatgaggatgggtggcgtgcggaacagagagatggctctgaagcatctctcgagtggtcctctgagaggcaagatatcgccgtgatctcagacagctactttcctcggtacttcattgctcctgcaaagttcttgggcaagcaggtgttgagttatggtcagaacctctccttctcctttcgagtggacaggcgagatactcgcctctctgcagaagaccttgtgcttgagggagctggcttaagagtatctgtacccttgatcgctcagggcaattcctatccaagtgagaccactgtgaagtatgtcttcaggctccatgaagcaacagattacccttggaggcctgctcttaccccttttgaatttcagaagctcctaaacaacttgacctctatcaagatacgtgggacatacagtgagagaagtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagagatgtgagctctgtgatgatggctactttggagaccccctgggtagaaacggccctgtgagactttgccgcctgtgccagtgcagtgacaacatcgatcccaatgcagttggaaattgcaatcgcttgacgggagaatgcctgaagtgcatctataacactgctggcttctattgtgaccggtgcaaagacggattttttggaaatcccctggctcccaatccagcagacaaatgcaaagcctgcaattgcaatctgtatgggaccatgaagcagcagagcagctgtaaccccgtgacggggcagtgtgaatgtttgcctcacgtgactggccaggactgtggtgcttgtgaccctggattctacaatctgcagagtgggcaaggctgtgagaggtgtgactgccatgccttgggctccaccaatgggcagtgtgacatccgcaccggccagtgtgagtgccagcccggcatcactggtcagcactgtgagcgctgtgaggtcaaccactttgggtttggacctgaaggctgcaaaccctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtgtcagtcactcagccagaatctacaggggacccaaacaacatgactcttttggcagaagaggctcgaaagcttgctgaacgtcataaacaggaagctgatgacattgttcgagtggcaaagacagccaatgatacgtcaactgaggcatacaacctgcttctgaggacactggcaggagaaaatcaaacagcatttgagattgaagagcttaataggaagtatgaacaagcgaagaacatctcacaggatctggaaaaacaagctgcccgagtacatgaggaggccaaaagggccggtgacaaagctgtggagatctatgccagcgtggctcagctgagccctttggactctgagacactggagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcagaccgcagaccaactcctagcccgagctgatgctgccaaggccctcgctgaagaagctgcaaagaagggacgggataccttacaagaagctaatgacattctcaacaacctgaaagattttgataggcgtgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcgagcgctgtccaaaagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggcttcacaggctgctcaagaagccgagatcaatgccagaaaagccaaaaactctgttactagcctcctcagcattattaatgacctcttggagcagctggggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatgactgtccttttgaaccaggaaaagtcacagagtttaaagagaagcaaattaaacatcctgaatcgggaacaaagggttttatctaataaagtgtctcttccattcacgttgctaccttacccacactttcccttctgatttgcgtgaggacgtggcatcctacgttactgtacagtggcataagcacatcgtgtgagcccatgtatgctggggtagagcaagtagccctcccctgtctcatcgataccagcagaacctcctcagtctcagtactcttgtttctatgaaggaaaagtttggctactaacagtagcattgtgatggccagtatatccagtccatggataaagaaaatgcatctgcatctcctacccctcttccttctaagcaaaaggaaataaacatcctgtgccaaaggtattggtcatttagaatgtcggtagccatccatcagtgcttttagttattatgagtgtaggacactgagccatccgtgggtcaggatgcaattatttataaaagtctccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaaattttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttctggcaattgttggagctggataggtaagttttataagggagtacattttgactgagcacttagggcatcaggaacagtgctacttactgatgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggcgtgctgttgcaaagttttcacgtcattgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccggggtggttaataaaatgcaacacttggcatttttatgttttaagaaaaacagtattttatttataataaaatctgaatatttgtaacccttta

SEQ ID NO: 147448 - DNA, 657 bp, Homo sapiens
  Payload ID: 9163
  Gene Symbol: LAMC1
  Gene Name: laminin, gamma 1 (formerly LAMB2)
  ENST ID: ENST00000484114
  CDS Start-End: 545-657
gcttattgcctgtactcagaaaacatgactgttgaagccctttgttcattcatttgaaagggatactttctcaaattgaaaagcttttgacatcacctatgtgcgtctcaagttccacaccagccgcccggagagctttgccatttacaagcgcacacgggaagacgggccctggattccttaccagtactacagtggttcctgtgagaacacctactccaaggcaaaccgcggcttcatcaggacaggaggggacgagcagcaggccttgtgtactgatgaattcagtgacatttctcccctcactgggggcaacgtggccttttctaccctggaaggaaggcccagcgcctataactttgacaatagccctgtgctgcaggaatgggtaactgccactgacatcagagtaactcttaatcgcctgaacacttttggagatgaagtgtttaacgatcccaaagttctcaagtcctattattatgccatctctgattttgctgtaggtggcagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgc

SEQ ID NO: 147449 - DNA, 5147 bp, Homo sapiens
  Payload ID: 9164
  Gene Symbol: LAMC2
  Gene Name: laminin, gamma 2
  Uniprot ID: Q13753
  ENST ID: ENST00000264144
  CDS Start-End: 66-3647
accaaccgaggcgccgggcagcgacccctgcagcggagacagagactgagcggcccggccccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactccggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgtcactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatggtcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatggaccagcctctcagtgtagatgaagaggggctggtcttactggagcagaagctttcccgagccaagacccagatcaacagccaactgcggcccatgatgtcagagctggaagagagggcacgtcagcagaggggccacctccatttgctggagacaagcatagatgggattctggctgatgtgaagaacttggagaacattagggacaacctgcccccaggctgctacaatacccaggctcttgagcaacagtgaagctgccataaatatttctcaactgaggttcttgggatacagatctcagggctcgggagccatgtcatgtgagtgggtgggatggggacatttgaacatgtttaatgggtatgctcaggtcaactgacctgaccccattcctgatcccatggccaggtggttgtcttattgcaccatactccttgcttcctgatgctgggcaatgaggcagatagcactgggtgtgagaatgatcaaggatctggaccccaaagaatagactggatggaaagacaaactgcacaggcagatgtttgcctcataatagtcgtaagtggagtcctggaatttggacaagtgctgttgggatatagtcaacttattctttgagtaatgtgactaaaggaaaaaactttgactttgcccaggcatgaaattcttcctaatgtcagaacagagtgcaacccagtcacactgtggccagtaaaatactattgcctcatattgtcctctgcaagcttcttgctgatcagagttcctcctacttacaacccagggtgtgaacatgttctccattttcaagctggaagaagtgagcagtgttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttaga

SEQ ID NO: 147450 - DNA, 4313 bp, Homo sapiens
  Payload ID: 9164
  Gene Symbol: LAMC2
  Gene Name: laminin, gamma 2
  Uniprot ID: Q13753
  ENST ID: ENST00000493293
  CDS Start-End: 116-3451
accacctgatcaaggaaaaggaaggcacagcggagcgcagagtgagaaccaccaaccgaggcgccgggcagcgacccctgcagcggagacagagactgagcggcccggccccgccatgcctgcgctctggctgggctgctgcctctgcttctcgctcctcctgcccgcagcccgggccacctccaggagggaagtctgtgattgcaatgggaagtccaggcagtgtatctttgatcgggaacttcacagacaaactggtaatggattccgctgcctcaactgcaatgacaacactgatggcattcactgcgagaagtgcaagaatggcttttaccggcacagagaaagggaccgctgtttgccctgcaattgtaactccaaaggttctcttagtgctcgatgtgacaactccggacggtgcagctgtaaaccaggtgtgacaggagccagatgcgaccgatgtctgccaggcttccacatgctcacggatgcggggtgcacccaagaccagagactgctagactccaagtgtgactgtgacccagctggcatcgcagggccctgtgacgcgggccgctgtgtctgcaagccagctgtcactggagaacgctgtgataggtgtcgatcaggttactataatctggatggggggaaccctgagggctgtacccagtgtttctgctatgggcattcagccagctgccgcagctctgcagaatacagtgtccataagatcacctctacctttcatcaagatgttgatggctggaaggctgtccaacgaaatgggtctcctgcaaagctccaatggtcacagcgccatcaagatgtgtttagctcagcccaacgactagaccctgtctattttgtggctcctgccaaatttcttgggaatcaacaggtgagctatggtcaaagcctgtcctttgactaccgtgtggacagaggaggcagacacccatctgcccatgatgtgattctggaaggtgctggtctacggatcacagctcccttgatgccacttggcaagacactgccttgtgggctcaccaagacttacacattcaggttaaatgagcatccaagcaataattggagcccccagctgagttactttgagtatcgaaggttactgcggaatctcacagccctccgcatccgagctacatatggagaatacagtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggagattgttattcaggggatgagaatcctgacattgagtgtgctgactgcccaattggtttctacaacgatccgcacgacccccgcagctgcaagccatgtccctgtcataacgggttcagctgctcagtgatgccggagacggaggaggtggtgtgcaataactgccctcccggggtcaccggtgcccgctgtgagctctgtgctgatggctactttggggacccctttggtgaacatggcccagtgaggccttgtcagccctgtcaatgcaacaacaatgtggaccccagtgcctctgggaattgtgaccggctgacaggcaggtgtttgaagtgtatccacaacacagccggcatctactgcgaccagtgcaaagcaggctacttcggggacccattggctcccaacccagcagacaagtgtcgagcttgcaactgtaaccccatgggctcagagcctgtaggatgtcgaagtgatggcacctgtgtttgcaagccaggatttggtggccccaactgtgagcatggagcattcagctgtccagcttgctataatcaagtgaagattcagatggatcagtttatgcagcagcttcagagaatggaggccctgatttcaaaggctcagggtggtgatggagtagtacctgatacagagctggaaggcaggatgcagcaggctgagcaggcccttcaggacattctgagagatgcccagatttcagaaggtgctagcagatcccttggtctccagttggccaaggtgaggagccaagagaacagctaccagagccgcctggatgacctcaagatgactgtggaaagagttcgggctctgggaagtcagtaccagaaccgagttcgggatactcacaggctcatcactcagatgcagctgagcctggcagaaagtgaagcttccttgggaaacactaacattcctgcctcagaccactacgtggggccaaatggctttaaaagtctggctcaggaggccacaagattagcagaaagccacgttgagtcagccagtaacatggagcaactgacaagggaaactgaggactattccaaacaagccctctcactggtgcgcaaggccctgcatgaaggagtcggaagcggaagcggtagcccggacggtgctgtggtgcaagggcttgtggaaaaattggagaaaaccaagtccctggcccagcagttgacaagggaggccactcaagcggaaattgaagcagataggtcttatcagcacagtctccgcctcctggattcagtgtctcggcttcagggagtcagtgatcagtcctttcaggtggaagaagcaaagaggatcaaacaaaaagcggattcactctcaagcctggtaaccaggcatatggatgagttcaagcgtacacagaagaatctgggaaactggaaagaagaagcacagcagctcttacagaatggaaaaagtgggagagagaaatcagatcagctgctttcccgtgccaatcttgctaaaagcagagcacaagaagcactgagtatgggcaatgccactttttatgaagttgagagcatccttaaaaacctcagagagtttgacctgcaggtggacaacagaaaagcagaagctgaagaagccatgaagagactctcctacatcagccagaaggtttcagatgccagtgacaagacccagcaagcagaaagagccctggggagcgctgctgctgatgcacagagggcaaagaatggggccggggaggccctggaaatctccagtgagattgaacaggagattgggagtctgaacttggaagccaatgtgacagcagatggagccttggccatggaaaagggactggcctctctgaagagtgagatgagggaagtggaaggagagctggaaaggaaggagctggagtttgacacgaatatggatgcagtacagatggtgattacagaagcccagaaggttgataccagagccaagaacgctggggttacaatccaagacacactcaacacattagacggcctcctgcatctgatgggtatgtgaacccacaacccacaaccttccagctccatgctccagggctttgctccagaacactcactatacctagccccagcaaaggggagtctcagctttccttaaggatatcagtaaatgtgctttgtttccaggcccagataactttcggcaggttcccttacatttactggaccctgttttaccgttgctaagatgggtcactgaacacctattgcacttgggggtaaaggtctgtgggccaaagaacaggtgtatataagcaacttcacagaacacgagacagcttgggaatcctgctaaagagtctggcctggaccctgagaagccagtggacagttttaagcagaggaataacatcaccactgtatatttcagaaagatcactagggcagccgagtggaggaaagcttgaagagggggttagagagaaggcaggttgagactacttaagatattgttgaaataattgaagagagaaatgacaggagcctgctctaaggcagtagaatggtggctgggaagatgtgaaggaagattttcccagtctgtgaagtcaagaatcacttgccggccgggtgtggtggctcacgcctgtaattctagcactttgggagactgaagcgggtggatcacccgaggtcaggagttgaagaccagcctggccaacatggtgaaaccctgtctctactaaaagtacaaaaattagctggatgtggtggtgggcgcctgtaattccagctactcaggagtctgaggcaggagaatcgcttgaacccaggaggcggaggttacagtgagccaagattgcaccactgctctccagcctggggaacagagcaagactgtctcaaaaaaaaaaaaaaaa

SEQ ID NO: 147451 - DNA, 3459 bp, Homo sapiens
  Payload ID: 9165
  Gene Symbol: LAMC3
  Gene Name: laminin, gamma 3
  ENST ID: ENST00000355452
  CDS Start-End: 1-773
gaaccctccagactgctgcccaggcgacgctacggcaaacagaacccctcacaaagctgcaccaggaggccagagccgccctgacccaggcttcctcatctgtccaggctgcgacagtgactgtcatgggagccaggactctgctggctgatctggaagacacgagaaagaagaccaagcaggcggagaggatgctgggaaacgcggcccctctttcctccagtgccaagaagaagggcagagaagcagaggtgttggccaaggacagtgccaagcttgccaaggccttgctgagggagcggaaacaggcgcaccgccgtgccagcaggctcaccagccagacgcaagccacgctccaacaggcgtcccagcaggtgctggcgtctgaagcacgcagacaggagctggaggaagctgagcgggtgggtgctgggctgagcgagatggagcagcagatccgggaatcgcgtatctcactggagaaggacatcgagaccttgtcagagctgcttgccaggctggggtcgctggacacccatcaagccccagcccaggccctgaacgagactcagtgggcactagaacgcctgaggctgcagctgggctccccggggtccttgcagaggaaactcagtctgctggagcaggaatcccagcagcaggagctgcagatccagggcttcgagagtgacctcgccgagatccgcgccgacaaacagaacctggaggccattctgcacagcctgcccgagaactgtgccagctggcagtgagggctgcccagatccccggcacacactcccccacctgctgtttacatgacccagggggtgcacactaccccacaggtgtgcccatacagacattccccggagccggctgctgtgaactcgcccccgtgtggatagtcactccctgccgattctgtctgtggcttcttccctgccagcaggactgagtgtgcgtacccagttcacctggacatgagtgcacactctcacccctgcacatgcataaacgggcacaccccagtgtcaataacatacacacgtgagggtgcatgtctgtgtgtatgacccacacgtgttcaagtctaatccatccagtcagcagcttacggtccacacacattacagtccacagctgttgtgagagccacctgtgtgctggacaccctctggatgttgggcaagttgttacatgagatgccctggggtgctacatccactcactccagatagcagggaggtctcagcagatctgcagagatcaagggggtcagcaacagccaaagcccctagtcccagagctggctgccctctgtttcacagcagctccctgacctgtgttgctgcgtgcactccctacagctcgacacagccaggggaccaacaggccaagaaatgcaagatcccgggagggttcttagcagcagaatctgaggcccagagaccctgaggccgtggccaggcctgctagtctggctagagcaaggcccattcctggcgggggtgtcattgccttcaccggacgcttccctctcagggtcctgggactgcaccagatgccctgagggaatggcccaccctggcctgtacccacttcagcctgtgatctatccaaagagccaggcccaaaagcgcctaggtcagggtgctcaggctaccaggagcacgcctctgtgcccccggcaacccagttgacctttaattgacgctttccagaccagccctgcggcaccacttgccatgcgggaggccaccagggtgtgcaagcctggctgccattccagtctgtcctgtctgggaatcgccctgtggccaggcccgcatgctggcctctgcccaggactcctcagcatttcctcttggcatccctcccctctcccagaccctcttccagcagatggcaaggcctcggcattgggaagtcaggcacctctgcgggcccagccccctcccgtggctcccctgacaggggcaggggtagggcagcagcacagaccaattccgttgaacgtggaaataaaggaccctttcactgggcagggtggtgtgcctcaccctccccggctggtgggcagccagggccctggctgtgggtgtgcatatgacacacctagtaggtggccagcatgtggaccggacgttggtaggaaggtggcaaaagccgagctcgtggctgggccagtacctcccattagagggctttgctggggttgtgtgatcacaggtacctaccctgtcctctcaggcacttaccacgtaaagcctaggagctggtgagttggaggggtggggtgcggagaggccctcagctgacctctggttcaggctcgagacgaactcacagccaagtgtccgaggatggtgaggagcagggaggggcgccatccaggagggggatggtgtgggtggggccttgaagggtggggaggcagagaaggaagcattccaggcaagagggtggacaacagtccggggcccgcagggttggggctcggccagcttgcatcactccaggaccccaggttgaatggggtgggatgttggagctgctcagtcagggctcttggccgcaggcctcaaacccctcctgaggtggtttcagcagaaaaggggtgttgggagggtcgcttggaaccctggagtaaaaacggctgccacgtgttggagatagcctagggaggggagcctgaggcttccgggataggttggcttccctcttcccccctcccgcctctcttcttggtctgtgtctctgctctcctctcctgtatctgcttcgttcttttctctttatttattgattttttttgagatggagtctcgctctgttgcccaggctggagtgcagtggcatgatctctgcccactgcatcctccacctcccaggtttaagcaattctcctgcctcagcctcccgagtagctaggactacaggtgcttgccaccatgcccagctaattttggtatttttagtagagacagggtttcaccacgttggtcaggctggtctcaaactcctgacctcagatgatatacctgcattggcctcttaaagttctgggatttcaggcatgagccactgcaaccggcccattcttttctctttgcagagtggctttctttgtttttcttgtgcctgataggagaggacacccacccctaccgccatcccccataatggccccaggtgtacatgtcatcaggtccagtgcttgcaagagacaagctggtgactctgtcctgattccagcttctcagcttaggtgaagtcccaccaacccccgttcaggataatgaggatctctggatctaaggccaataatggatgaccggtgccaccccccaacctaatgggagatggtgttcagagaagaggtgtgctcctccacagaaaactgtaaaatcaaggctacggtgggggattgacatgattaaactgagctaggagtga

SEQ ID NO: 147452 - DNA, 6133 bp, Homo sapiens
  Payload ID: 9165
  Gene Symbol: LAMC3
  Gene Name: laminin, gamma 3
  Uniprot ID: Q9Y6N6
  ENST ID: ENST00000361069
  CDS Start-End: 134-4861
gccgccgccgcccgcccctccctccagcctccccgccccgcaggggaaggcgggtcctggcggccagcgcgcggtccgcgcccaccctagccgagcggggccggcagagcgcgcggcgtcggtgcccttgaccatggcggcggctgcgcttctgctggggctggcgctgctggcaccgcgggcggccggcgcgggcatgggcgcgtgctatgacggcgcagggcgcccgcagcgctgcctgccggtgttcgagaacgcggcgtttgggcggctcgcccaggcctcgcacacgtgcggcagcccgcccgaggacttctgtccccacgtgggcgccgcgggcgcgggggctcattgccagcgctgcgacgccgccgacccccagcgccaccacaacgcctcctacctcaccgacttccacagccaggacgagagcacctggtggcagagcccgtccatggccttcggcgtgcagtaccccacctcggtcaacatcaccctccgcctagggaaggcttatgagatcacgtatgtgaggctgaagttccacaccagtcgccctgagagctttgccatctacaagcgcagccgcgccgacggcccatgggagccctaccagttctacagcgcctcctgccagaagacctacggccggcccgagggccagtacctgcgccccggcgaggacgagcgcgtggccttctgcacctctgagttcagcgacatctccccgctgagtggcggcaacgtggccttctccaccctggagggccggcccagcgcctacaacttcgaggagagccctgggctgcaggagtgggtcaccagcaccgaactcctcatctctctagaccggctcaacacgtttggggacgacatcttcaaggaccccaaggtgctccagtcctactattatgccgtgtccgacttctctgtgggcggcaggtgcaagtgcaacgggcatgccagcgagtgcggccccgacgtggcaggccagttggcctgccggtgccagcacaacaccaccggcacagactgtgagcgctgcctgcccttcttccaggaccgcccgtgggcccggggcaccgccgaggctgcccacgagtgtctgccctgcaactgcagtggccgctccgaggaatgcacgtttgatcgggagctcttccgcagcacaggccacggcgggcgctgtcaccactgccgtgaccacacagctgggccacactgtgagcgctgtcaggagaatttctatcactgggacccgcggatgccatgccagccctgtgactgccagtcggcaggctccctacacctccagtgcgatgacacaggcacctgcgcctgcaagcccacggtgactggctggaagtgtgaccgctgtctgcccgggttccactcgctcagtgagggaggctgcagaccctgcacttgcaatcccgctggcagcctggacacctgtgacccccgcagtgggcgctgcccctgcaaagagaatgtggaaggcaacctatgtgacagatgtcgcccggggacctttaacctgcagccccacaatccagctggctgcagcagctgtttctgctatggccactccaaggtgtgcgcgtccactgcccagttccaggtgcatcacatcctcagcgatttccaccagggagccgaaggctggtgggccagaagtgtggggggctctgagcaccccccacaatggagcccaaatggggtcctcctgagcccagaagacgaggaggagctcacagcaccagagaagttcctgggagaccagcggttcagctatgggcagcccctcatactgaccttccgggtgccccccggggactccccactccctgtacagctgaggctggaagggacaggcttggccctgtccctgaggcactctagcctgtctggcccccaggatgccgggcatcccagggaggtagagctcaggttccacctgcaggagacctccgaggacgtggcccctccactgccccccttccacttccagcggctcctcgccaacctgaccagcctccgcctccgcgtcagtcccggccccagccctgccggtccagtgttcctgactgaggtccggctcacatccgcccggccagggctttccccgccagcctcctgggtggagatttgttcatgtcccactggctacacgggccagttctgtgaatcctgtgctccgggatacaagagggagatgccacaggggggtccctatgccagctgtgtcccctgcacctgtaaccagcatggcacctgtgaccccaacacagggatctgtgtctgcagccaccataccgagggcccatcctgtgaacgctgtttgccaggtttctatggcaaccctttcgcgggccaagccgacgactgccagccctgtccctgccctggccagtcggcctgtacgaccatcccagagagccgggaggtggtgtgtacccactgccccccgggccagagagggcggcgctgtgaggtctgtgatgatggcttttttggggacccgctggggctctttgggcacccccagccctgccaccagtgccagtgtagcgggaacgtggaccccaatgccgtgggcaactgtgaccccctgtctggccactgcctgcgctgcctgcacaacaccacgggtgaccactgtgagcactgtcaggaaggcttctacgggagcgccctggcccctcgacccgcagacaaatgcatgccttgcagctgtcacccacagggctcggtcagtgagcagatgccctgcgacccagtgacaggccaatgctcctgcctgcctcatgtgactgcacgggactgcagccgctgctaccctggcttcttcgacctccagcctgggaggggctgccggagctgcaagtgtcacccactgggctcccaggaggaccagtgccatcccaagactggacagtgcacctgccgcccaggtgtcacaggccaggcctgtgacaggtgccagctgggtttcttcggcttctccatcaagggctgccgggcctgcaggtgctccccactgggcgctgcctcggcccagtgccacgagaacggcacatgcgtgtgcaggcctggcttcgagggctacaaatgtgaccgctgccacgacaacttcttcctcacggcagacggcacacactgccagcaatgtccgtcctgctacgccctggtgaaggaggaggcagccaagctgaaggccagactgactttgacggaggggtggctccaagggtccgactgtggcagtccctggggaccactagacattctgctgggagaggccccaaggggggacgtctaccagggccatcacctgcttccaggggctcgggaagccttcctggagcagatgatgagcctcgagggtgctgtcaaggccgcccgggagcagctgcagaggctgaacaagggtgcccgctgtgcccaggccggatcccagaagacctgcacccagctggcagacctggaggcagtgctggagtcctcggaagaggagattctgcatgcagctgccattctcgcgtctctggagattcctcaggaaggtcccagtcagccgaccaaatggagccacctggccacagaggcccgtgccctcgccaggagccacagagacaccgccaccaagatcgcagccactgcttggagggccctgctcgcctccaacaccagctacgcgcttctctggaatctgctggagggaagggtggccctagagacccagcgggacctggaggacaggtaccaggaggtccaggcggcccagaaagcactgaggacggctgtggcagaggtgctgcctgaagcggaaagcgtgttggccaccgtgcagcaagttggcgcagatacagccccgtacctggccttgctggcttccccgggagctctgcctcagaagtcccgggctgaagacctgggcctgaaggcgaaggccctggagaagacagttgcatcatggcagcacatggccactgaggctgcccgaaccctccagactgctgcccaggcgacgctacggcaaacagaacccctcacaaagctgcaccaggaggccagagccgccctgacccaggcttcctcatctgtccaggctgcgacagtgactgtcatgggagccaggactctgctggctgatctggaaggaatgaagctgcagtttccccggcccaaggaccaggcggcattgcagaggaaggcagactccgtcagtgacagactccttgcagacacgagaaagaagaccaagcaggcggagaggatgctgggaaacgcggcccctctttcctccagtgccaagaagaagggcagagaagcagaggtgttggccaaggacagtgccaagcttgccaaggccttgctgagggagcggaaacaggcgcaccgccgtgccagcaggctcaccagccagacgcaagccacgctccaacaggcgtcccagcaggtgctggcgtctgaagcacgcagacaggagctggaggaagctgagcgggtgggtgctgggctgagcgagatggagcagcagatccgggaatcgcgtatctcactggagaaggacatcgagaccttgtcagagctgcttgccaggctggggtcgctggacacccatcaagccccagcccaggccctgaacgagactcagtgggcactagaacgcctgaggctgcagctgggctccccggggtccttgcagaggaaactcagtctgctggagcaggaatcccagcagcaggagctgcagatccagggcttcgagagtgacctcgccgagatccgcgccgacaaacagaacctggaggccattctgcacagcctgcccgagaactgtgccagctggcagtgagggctgcccagatccccggcacacactcccccacctgctgtttacatgacccagggggtgcacactaccccacaggtgtgcccatacagacattccccggagccggctgctgtgaactcgcccccgtgtggatagtcactccctgccgattctgtctgtggcttcttccctgccagcaggactgagtgtgcgtacccagttcacctggacatgagtgcacactctcacccctgcacatgcataaacgggcacaccccagtgtcaataacatacacacgtgagggtgcatgtctgtgtgtatgacccacacgtgttcaagtctaatccatccagtcagcagcttacggtccacacacattacagtccacagctgttgtgagagccacctgtgtgctggacaccctctggatgttgggcaagttgttacatgagatgccctggggtgctacatccactcactccagatagcagggaggtctcagcagatctgcagagatcaagggggtcagcaacagccaaagcccctagtcccagagctggctgccctctgtttcacagcagctccctgacctgtgttgctgcgtgcactccctacagctcgacacagccaggggaccaacaggccaagaaatgcaagatcccgggagggttcttagcagcagaatctgaggcccagagaccctgaggccgtggccaggcctgctagtctggctagagcaaggcccattcctggcgggggtgtcattgccttcaccggacgcttccctctcagggtcctgggactgcaccagatgccctgagggaatggcccaccctggcctgtacccacttcagcctgtgatctatccaaagagccaggcccaaaagcgcctaggtcagggtgctcaggctaccaggagcacgcctctgtgcccccggcaacccagttgacctttaattgacgctttccagaccagccctgcggcaccacttgccatgcgggaggccaccagggtgtgcaagcctggctgccattccagtctgtcctgtctgggaatcgccctgtggccaggcccgcatgctggcctctgcccaggactcctcagcatttcctcttggcatccctcccctctcccagaccctcttccagcagatggcaaggcctcggcattgggaagtcaggcacctctgcgggcccagccccctcccgtggctcccctgacaggggcaggggtagggcagcagcacagaccaattccgttgaacgtggaaataaaggaccctttcactggg

SEQ ID NO: 147453 - DNA, 1647 bp, Homo sapiens
  Payload ID: 9166
  Gene Symbol: LANCL1
  Gene Name: LanC lantibiotic synthetase component C-like 1 (bacterial)
  Uniprot ID: O43813
  ENST ID: ENST00000233714
  CDS Start-End: 76-1275
gagaagggcttcaggacgcgggaggcgcacttgcttcaagtcgcgggcgtgggaacggggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaa

SEQ ID NO: 147454 - DNA, 4781 bp, Homo sapiens
  Payload ID: 9166
  Gene Symbol: LANCL1
  Gene Name: LanC lantibiotic synthetase component C-like 1 (bacterial)
  Uniprot ID: O43813
  ENST ID: ENST00000443314
  CDS Start-End: 344-1543
actgtccggggctgcggggtgagaggccagggccgagaagggcttcaggacgcgggaggcgcacttgcttcaagtcgcgggcgtgggaacggggttgcaaaacggggcctctttgtccgggtgggttaagggccctggcagctttttcgcgaaggcgccatgtcctagcagttgggccgcagtgggcccgaggtccactcggaccgccgagacggctcgatggccctggagctggaggaagggggatacctgggcgccgccgccgccctcgcaactcggccgaggcccctatctcaacctagtttctgtttttcccctgttctgcaggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaaaggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactatata

SEQ ID NO: 147455 - DNA, 4503 bp, Homo sapiens
  Payload ID: 9166
  Gene Symbol: LANCL1
  Gene Name: LanC lantibiotic synthetase component C-like 1 (bacterial)
  Uniprot ID: O43813
  ENST ID: ENST00000441020
  CDS Start-End: 66-1265
taaaatagcccttctgttactgtccggggctgcggggtgagaggccagggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaaaggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactatata

SEQ ID NO: 147456 - DNA, 4602 bp, Homo sapiens
  Payload ID: 9166
  Gene Symbol: LANCL1
  Gene Name: LanC lantibiotic synthetase component C-like 1 (bacterial)
  Uniprot ID: O43813
  ENST ID: ENST00000450366
  CDS Start-End: 165-1364
aactgggcggtaaaatagcccttctgttactgtccggggctgcggggtgagaggccagggccgagaagggcttcaggacgcgggaggcgcacttgcttcaagtcgcgggcgtgggaacggggttgcaaaacggggcctctttgtccgggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaaaggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactatata

SEQ ID NO: 147457 - DNA, 590 bp, Homo sapiens
  Payload ID: 9166
  Gene Symbol: LANCL1
  Gene Name: LanC lantibiotic synthetase component C-like 1 (bacterial)
  ENST ID: ENST00000453956
  CDS Start-End: 103-351
gagaagggcttcaggacgcgggaggcgcacttgcttcaagtcgcgggcgtgggaacggggttgcaaaacggggcctctttgtccgggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcagtgggaagaattgggaagagttccaaaatacaatgcctgaagcggaggtaatgaggattgatctcaggaataaaatatgtccagaagcatgttttaaaaagttaacccgtaacaggaatccatacaggaatccatacaggggagattgatttggattttgattcacaacaccttaaagttttgtgttttttttttttcattcagtaagtctttgcgtaaagcctgccacagaaagtattgctgtgctttacttacatctttatgatgtatttggggaccctgcctaccta

SEQ ID NO: 147458 - DNA, 808 bp, Homo sapiens
  Payload ID: 9166
  Gene Symbol: LANCL1
  Gene Name: LanC lantibiotic synthetase component C-like 1 (bacterial)
  ENST ID: ENST00000448951
  CDS Start-End: 220-808
agagtttgggatggcagcctcagaaggacaaacttaggccaaggagggagggagttggggtggagactgagcttctccagttggaggtctggagctaggactcttcattgaaaccggagagaaggaaaaggagagagtgaggctgactttttaactgaactccaaaattctctgagcaatagaatgggcctaatatgtaccaggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaaga

SEQ ID NO: 147459 - DNA, 1270 bp, Homo sapiens
  Payload ID: 9166
  Gene Symbol: LANCL1
  Gene Name: LanC lantibiotic synthetase component C-like 1 (bacterial)
  Uniprot ID: O43813
  ENST ID: ENST00000431941
  CDS Start-End: 71-1270
ctggcaggaactgggcggtaaaatagcccttctgttactgtccggggctgcggggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctga

SEQ ID NO: 147460 - DNA, 441 bp, Homo sapiens
  Payload ID: 9166
  Gene Symbol: LANCL1
  Gene Name: LanC lantibiotic synthetase component C-like 1 (bacterial)
  ENST ID: ENST00000412863
  CDS Start-End: 1-441
gatttgtgaaacaattttaacctctggagaaaacctagctaggaagagaaacttcacggcaaagtctccactgatgtatgaatggtaccaggaatattatgtaggggctgctcatggcctggctggaatttattactacctgatgcaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccc

SEQ ID NO: 147461 - DNA, 4353 bp, Homo sapiens
  Payload ID: 9167
  Gene Symbol: LANCL2
  Gene Name: LanC lantibiotic synthetase component C-like 2 (bacterial)
  Uniprot ID: Q9NS86
  ENST ID: ENST00000254770
  CDS Start-End: 579-1931
gggctggcgcagcaggggccggtgaaatgcaggctgacgacggcgcgccaggggctgagctcgccccggtcggcgacgcgcacacaccttgagtgacagcgacctcttctctacaggttttccccgcgggagcgtggccctagcgggcgttcggttttctttggaaatcgcggagggggctggccgggcgcagcgatccccaccccgggactccagccccggccgtgcgcgtcgccgcggacgggctctgcgggccacggggaaggtgcgaggaggcgcgagcaggctgtgagccgctgggcgctcccgcgagcccgctcctctccgtcgggagcagggcaaaggcgccaggaacagggcagaggcacagcgcccaccgcctctgcggccgcctgatgtgcgagcagcccgcgacgaggcagtgcacgctcagacgccccgctcctcccgccagcgcgcggcctcgctcctcctagaggacgctctctgcgcgggccctcggaggaggcggcggcggggcgagctgcagcgccgggacaggaggtttgtccccgcccgcgcgccgtaccgcggcggagatgggcgagaccatgtcaaagaggctgaagctccacctgggaggggaggcagaaatggaggaacgggcgttcgtcaaccccttcccggactacgaggccgccgccggggcgctgctcgcctccggagcggccgaagagacaggctgtgttcgtcccccggcgaccacggatgagcccggcctcccttttcatcaggacgggaagatcattcataatttcataagacggatccagaccaaaattaaagatcttctgcagcaaatggaagaagggctgaagacagctgatccccatgactgctctgcttatactggctggacaggcatagcccttttgtacctgcagttgtaccgggtcacatgtgaccaaacctacctgctccgatccctggattacgtaaaaagaacacttcggaatctgaatggccgcagggtcaccttcctctgtggggatgctggccccctggctgttggagctgtgatttatcacaaactcagaagtgactgtgagtcccaggaatgtgtcacaaaacttttgcagctccagagatcggttgtctgccaagaatcagaccttcctgatgagctgctttatggacgggcaggttatctgtatgccttactgtacctgaacacagagataggtccaggcaccgtgtgtgagtcagctattaaagaggtagtcaatgctattattgaatcgggtaagactttgtcaagggaagaaagaaaaacggagcgctgcccgctgttgtaccagtggcaccggaagcagtacgttggagcagcccatggcatggctggaatttactatatgttaatgcagccggcagcaaaagtggaccaagaaaccttgacagaaatggtgaaacccagtattgattatgtgcgccacaaaaaattccgatctgggaattacccatcatcattaagcaatgaaacagaccggctggtgcactggtgccacggcgccccgggggtcatccacatgctcatgcaggcgtacaaggtctttaaggaggagaagtacttgaaagaggccatggagtgtagcgatgtgatttggcagcgaggtttgctgcggaagggctacgggatatgccatgggactgctggcaacggctattccttcctgtccctttaccgtctcacgcaggataagaagtacctctaccgagcttgcaagtttgcagagtggtgtctagattacggagcacacgggtgccgcattcctgacagaccctattcgctctttgaaggcatggctggcgctattcactttctctctgatgtcctgggaccagagacatcacggtttccagcatttgaacttgactcttcgaagagggattaaaaggtgcaaaaagacaactaaaatacccatttggaccaaaagccaccagattgcttagtgcctgacacagaaacaactgggaatcctgaaagagaagcagacaccgtcacaggcccctctggttagactagcatgagtgaccgaagccatccatcaacattttctaacagcaccctcatcaatataaaatatgacttcttcacatacagattctctgtagtgtttgcatgtttcttggtgtttgttgtctccaggtgtaagctgttttaaatggaaggcccttctattcctgagggctcagagctgaccatgcatgaatgtatggcagtgtccacttttctgtataaaatgtataaagtggggtttcttccatattgacaaatgagggaacaggtggtgtctatcttgtatatcagaaagattatctagggtctatcctagtgataatacattgtcagccttttctgtggcaccttccagatgagaatgagggagcgaccactccaaggacggacaggaccagcagttctgcaggggcgtgctggggtggtttgggagtgcacagctgaacgcttcccgtttggattttacactcaccttcgtgttttaaagaagcctcagagtgcattgcagctctgtcagggccccattcccagcagaggcttcaggtgctttgtgtagagtccagggcagctggagctttgttggggagacttctggacccaaagggagctttcccaagaagcctttgatggccacactgtaggcagcagtgactaagcactggcagttccagaacatttacccaggtatatgttactaaaacaggctccacctcagtttatcaacattataagttactgttctaagaaaagtaaatacagttccagatgggttattgcagattaacagaaagacactcaactggactcatgtccctgcaattaaacttacttcaaccttttggaaagttatcaaaatctaaatttggaatgaatgcatttcctattttttgtctacttttgggtgataaaaagtactagcccttatttatagatatgagaaacataatgttctaaccaacaacattatggtatttgtgtgacttttatttgaaaaaatgtgagcagtaatttgggttagcctaccttcattaattctatcacatagatttcagtttttagaagggtttctgtcatcatggaagaggtggtctgggactaggtacttctcgtcttgtgagctaaggcttgtgtcatgaaagacaagaggcctctcttaacagcccagtccttgtctgcagggggaggcctgagcatttcccagccccagtgtccacacctctcagaaaagagaaaaaagaatgtcagtttaggagaaaagcttcctttttacttgtgtggttatgtgtggggctggcacccgaaatgtgtgacattcagcttctaaacgatgcctggagagtctgtttgctgcagacacccttgctcctgagtcattattttctttcatgttagattgatgacttctgtgaatagaaatcatcctgatcctattttacctggcctccagggcctgttgatgggctttgcaggcagtccagcagcccacacctgcaggcaggatgctgtcgtcaatgagctgagggtagctgctttgctgaagacctcacacgatgtccaatctcatccaaataacattgttcccatcctccccacccaccacatcaaaacataacacatcacagcactcagtagaggtcctgcctccccatttctcaagggaagccagtaggcaacacagccagcacggtgctctccagggcagcccctctcagacgaggaggcagcgggtgcagccaggtgtctgcagagcagccacaaaggtggcctaggatgcgggtgtctccccaggtgagtccatccacacacgtttgaaaaacactattagtctttctaacacactgagggaaagattaaaatctgtggaataaaggaggagattttatttacagatttttttaaaagccacctgggttgacaccttcctacttatccactagatgtcatcagaggtgctgttccgtggttctgcattaacccctgcctcatgtctgtaacatgtgacagtaattccagctcggtccctccaggcaaaggagaaacgggacttacttcacaggacagaggattgacagaagtcagtttaagataagtgtttgaatcagatttcagtacatctcattcatttcttagatttgtattcacaattgtgttctctaaaatgtgtctaaattttaaaaatatgtacatgcataatgtcattttaaaatctgaaggaaagaatttgaagtccacaaaaagtgtttgaggttctttggttttgttagtaaaagccagttctgtggtgatgacctatggaa

SEQ ID NO: 147462 - DNA, 1663 bp, Homo sapiens
  Payload ID: 9167
  Gene Symbol: LANCL2
  Gene Name: LanC lantibiotic synthetase component C-like 2 (bacterial)
  ENST ID: ENST00000452107
  CDS Start-End: 1-122
cggactacgaggccgccgccggggcgctgctcgcctccggagcggccgaagagacaggctgtgttcgtcccccggcgaccacggatgagcccggcctcccttttcatcaggacgggaagtagaaaccaaaggtcaagacacaggaggcctaagttactaacatggagtcaaaaagtttttaagaagttggatggagaaccagacagttactctttttggtgcattcagtaacagaagcaaagttaaatacatttacaagcacatcaccaaaacaatagggaatggcaaatccagaaagcattgctaatcattcataatttcataagacggatccagaccaaaattaaagatcttctgcagcaaatggaagaagggctgaagacagctgatccccatgactgctctgcttatactggctggacaggcatagcccttttgtacctgcagttgtaccgggtcacatgtgaccaaacctacctgctccgatccctggattacgtaaaaagaacacttcggaatctgaatggccgcagggtcaccttcctctgtggggatgctggccccctggctgttggagctgtgatttatcacaaactcagaagtgactgtgagtcccaggaatgtgtcacaaaacttttgcagctccagagatcggttgtctgccaagaatcagaccttcctgatgagctgctttatggacgggcaggttatctgtatgccttactgtacctgaacacagagataggtccaggcaccgtgtgtgagtcagctattaaagaggtagtcaatgctattattgaatcgggtaagactttgtcaagggaagaaagaaaaacggagcgctgcccgctgttgtaccagtggcaccggaagcagtacgttggagcagcccatggcatggctggaatttactatatgttaatgcagccggcagcaaaagtggaccaagaaaccttgacagaaatggtgaaacccagtattgattatgtgcgccacaaaaaattccgatctgggaattacccatcatcattaagcaatgaaacagaccggctggtgcactggtgccacggcgccccgggggtcatccacatgctcatgcaggcgtacaaggtctttaaggaggagaagtacttgaaagaggccatggagtgtagcgatgtgatttggcagcgaggtttgctgcggaagggctacgggatatgccatgggactgctggcaacggctattccttcctgtccctttaccgtctcacgcaggataagaagtacctctaccgagcttgcaagtttgcagagtggtgtctagattacggagcacacgggtgccgcattcctgacagaccctattcgctctttgaaggcatggctggcgctattcactttctctctgatgtcctgggaccagagacatcacggtttccagcatttgaacttgactcttcgaagagggattaaaaggtgcaaaaagacaactaaaatacccatttggaccaaaagccaccagattgcttagtgcctgacacagaaacaactgggaatcctgaaagagaagcagacaccgtcacaggcccctctggttagactagcatgagtgaccgaagccatccatcaacattttctaacagcaccctcatcaatataaaatatgacttcttcacataca

SEQ ID NO: 147463 - DNA, 3063 bp, Homo sapiens
  Payload ID: 9168
  Gene Symbol: LANCL3
  Gene Name: LanC lantibiotic synthetase component C-like 3 (bacterial)
  Uniprot ID: Q6ZV70
  ENST ID: ENST00000378619
  CDS Start-End: 220-1482
gcccgggccactcgggagcctcgcggcagcccggcgccccacttggccatccgctccttgcccgcctcctcttgtcacctcccgtctcatccttctcgctccttccccgccgcatacaccggcatccgagtgcctcagagagccggaggtggtgtgcggggctgcagggcacgacttcaagcggtcctcagctccgcactagggggcacgggcaacagcatggacaccaagcgctgcttcgccaatcgcttcgatgactaccagggcagcctgctggcgggccagtgtgaggaggcggtggcgcccttggtcaccgccaccatcgagcgcatcctccaggagcttcccccactcgggggcggcgcggaggcccgaggggcgacggcgggggctagcgcctgccagggggggctttatggcggcgtggccggagtggcgtatatgctctaccacgtctcgcagagcccgcttttcgccacggcccgggaacgctacctgcgctcggctaagcgcctcatcgacgcgtgcgcccgcgctgaggagtggggcgaaccggacgccgacacccgcgccgccttcctgctcgggggcgcgggcgtgtacgccgtggccacgctcgtataccacgccctgggccggtccgactacgtgcagccgctgggcaagttccgggctctgtgtgccgtctgcgcgccggtctccttcctggagtgcggctccgacgagctgttcgtgggccgcgcgggttacctgtgtgccgcgctggtgctcaagcagaaactcgcccaggaggtgctgactccagcacagatcaagtcaatttgtcaggcaattctggactctgggaagcagtatgccataaagaagaggaaaccattccccctgatgtattcttactatggaaccgaatacttgggggcagctcacggcttgtcgtctattcttcagatgcttctttcttaccatgagcatctcaagccctcagatcgggaattggtatggcagagcgtggactttctcatggaacaggaacaaaactgcaactggccacctgagctcggcgagaccatcgagagagagaatgagctggtgcactggtgccatggcgctccaggaattgcctatctgtttgccaaagcttatctggtttccaagaaaccgcagtacctggacacatgtattcggtgtggggaactcacatggcagaaaggcctgctaaagaaggggcctgggatttgccatggagtagccggcagtgcctatgtcttcctgctgctgtaccggctcacgggaaactctaaatacatctaccgagctcaaaggtttgctcaattcttatttaccgaggaattcaaggccggttctcgggtccttgaaagtatatacagcttgtatgaaggcttctctgggacagtgtgctttctgattgacctgctgcagcccaatcaggctgaattcccactcttcagcgtctttgtttagaaggctctatcttccactgtggccctgcagagatcccctgagccaagccgaggcagtttccacataagccacattcaatggtatcgcaaccatgagccttaacattgccatcagaaggaaggaatcaggcaggtgaaggcaacatgatgccagatttgagaaaggatctgcaaaataaagataccacaattcatcttaaaactgcagagatttaatgtgtcagggaatagatgtgaaacaagggatcataggaaaaggggaaagagaaatgatctgtttttcagttatgacatagaaaaccaaactgcaagtgtagactatgacaaaaaatacactaatacctttgcaatctgaatgagaatttgaccatttgtgtgtgccctctacccttaaattcagaaataaagacaataaaaaattaaaataattgcccagctgaaaactgctatgaggaatggattgtcaggttgctgaagtataaaaataaactcttggttgtcctgtgcttatacttattgaaatttatggtttttactgagcaaagatatttgcatatgaatctctatttttttcattaccctgggcaatttaaagaaatcatatcatagcgtagttcagatactaaaatttgaagtttccttaggccctagaacatctcttttcctggttccttttttttcctcaaagctcaattagaatagcaaaatttataagctagtaaacttatactatagcaagtgttgctgtaaagtgtttttctccataggaagtgtgaactgtgtattgtctattgttagtaattttaaaaatgcctttatgtacataatcttgatggagctattagctgaactataaaatatgctcttggtaaatatcactaatttcaaagatcaggggaaccactacaaagacgtgtcatttctgcctttgtttgggacaggcagacaggctgaggaagtcaccagtgattgtggaaataattttgctccattttatactattaaatgaagagatgagtgaattctgtggttggttaccttaccttccaagatacagggtccactagaaattggctgtaatactcattgagccaagttgtcatatcaaattcaaccctgctgtaaacacatagaagttgtgaaactgcttcaagtaaatagtggtttgcagaacactgtaggagcatctgtcacttcattatgcagagcataagttgatccttttcctagaattttgtcagtggcaattgcatatatcagattgagtaggaaattgtgtactgtataagacttatttaaatagtcattaaatatttggatatattatgtgtgtgtgtgtgtgtgtgtgtgtgtgtatggtgtgtattccatatctattcccatgtaaatccaaatacttattctttatttcagtaattcttaacttgaatcatagactttggaacgagttagggaatgctctgttgcctaaaaagcaaacctacaagtatgttggtgtgtgtatgtgtatggaccagtttgtttgtgtgtgtgtgtgctcattttgaggggacaaggatctctagcattcataacattctca

SEQ ID NO: 147464 - DNA, 10298 bp, Homo sapiens
  Payload ID: 9168
  Gene Symbol: LANCL3
  Gene Name: LanC lantibiotic synthetase component C-like 3 (bacterial)
  Uniprot ID: Q6ZV70
  ENST ID: ENST00000378621
  CDS Start-End: 303-1469
aagctgcggcggcgcaggagggggcgggttcagcgagggcgcggcctctgagggggggcgcaggacacgcatcccccgcgatcgcccgggccactcgggagcctcgcggcagcccggcgccccacttggccatccgctccttgcccgcctcctcttgtcacctcccgtctcatccttctcgctccttccccgccgcatacaccggcatccgagtgcctcagagagccggaggtggtgtgcggggctgcagggcacgacttcaagcggtcctcagctccgcactagggggcacgggcaacagcatggacaccaagcgctgcttcgccaatcgcttcgatgactaccagggcagcctgctggcgggccagtgtgaggaggcggtggcgcccttggtcaccgccaccatcgagcgcatcctccaggagcttcccccactcgggggcggcgcggaggcccgaggggcgacggcgggggctagcgcctgccagggggggctttatggcggcgtggccggagtggcgtatatgctctaccacgtctcgcagagcccgcttttcgccacggcccgggaacgctacctgcgctcggctaagcgcctcatcgacgcgtgcgcccgcgctgaggagtggggcgaaccggacgccgacacccgcgccgccttcctgctcgggggcgcgggcgtgtacgccgtggccacgctcgtataccacgccctgggccggtccgactacgtgcagccgctgggcaagttccgggctctgtgtgccgtctgcgcgccggtctccttcctggagtgcggctccgacgagctgttcgtgggccgcgcgggttacctgtgtgccgcgctggtgctcaagcagaaactcgcccaggaggtgctgactccagcacagatcaagtcaatttgtcaggcaattctggactctgggaagcagtatgccataaagaagaggaaaccattccccctgatgtattcttactatggaaccgaatacttgggggcagctcacggcttgtcgtctattcttcagatgcttctttcttaccatgagcatctcaagccctcagatcgggaattggtatggcagagcgtggactttctcatggaacaggaacaaaactgcaactggccacctgagctcggcgagaccatcgagagagagaatgagctggtgcactggtgccatggcgctccaggaattgcctatctgtttgccaaagcttatctggtttccaagaaaccgcagtacctggacacatgtattcggtgtggggaactcacatggcagaaaggcctgctaaagaaggggcctgggatttgccatggagtagccggcagtgcctatgtcttcctgctgctgtaccggctcacgggaaactctaaatacatctaccgagctcaaagttcattccctgtaaacttgataaagatggaacatctgctgtataccagacaacattgcttttaatagatattacctctgactggtttgctcaattcttatttaccgaggaattcaaggccggttctcgggtccttgaaagtatatacagcttgtatgaaggcttctctgggacagtgtgctttctgattgacctgctgcagcccaatcaggctgaattcccactcttcagcgtctttgtttagaaggctctatcttccactgtggccctgcagagatcccctgagccaagccgaggcagtttccacataagccacattcaatggtatcgcaaccatgagccttaacattgccatcagaaggaaggaatcaggcaggtgaaggcaacatgatgccagatttgagaaaggatctgcaaaataaagataccacaattcatcttaaaactgcagagatttaatgtgtcagggaatagatgtgaaacaagggatcataggaaaaggggaaagagaaatgatctgtttttcagttatgacatagaaaaccaaactgcaagtgtagactatgacaaaaaatacactaatacctttgcaatctgaatgagaatttgaccatttgtgtgtgccctctacccttaaattcagaaataaagacaataaaaaattaaaataattgcccagctgaaaactgctatgaggaatggattgtcaggttgctgaagtataaaaataaactcttggttgtcctgtgcttatacttattgaaatttatggtttttactgagcaaagatatttgcatatgaatctctatttttttcattaccctgggcaatttaaagaaatcatatcatagcgtagttcagatactaaaatttgaagtttccttaggccctagaacatctcttttcctggttccttttttttcctcaaagctcaattagaatagcaaaatttataagctagtaaacttatactatagcaagtgttgctgtaaagtgtttttctccataggaagtgtgaactgtgtattgtctattgttagtaattttaaaaatgcctttatgtacataatcttgatggagctattagctgaactataaaatatgctcttggtaaatatcactaatttcaaagatcaggggaaccactacaaagacgtgtcatttctgcctttgtttgggacaggcagacaggctgaggaagtcaccagtgattgtggaaataattttgctccattttatactattaaatgaagagatgagtgaattctgtggttggttaccttaccttccaagatacagggtccactagaaattggctgtaatactcattgagccaagttgtcatatcaaattcaaccctgctgtaaacacatagaagttgtgaaactgcttcaagtaaatagtggtttgcagaacactgtaggagcatctgtcacttcattatgcagagcataagttgatccttttcctagaattttgtcagtggcaattgcatatatcagattgagtaggaaattgtgtactgtataagacttatttaaatagtcattaaatatttggatatattatgtgtgtgtgtgtgtgtgtgtgtgtgtgtatggtgtgtattccatatctattcccatgtaaatccaaatacttattctttatttcagtaattcttaacttgaatcatagactttggaacgagttagggaatgctctgttgcctaaaaagcaaacctacaagtatgttggtgtgtgtatgtgtatggaccagtttgtttgtgtgtgtgtgtgctcattttgaggggacaaggatctctagcattcataacattctcaaagaatctgaccaaagaaaggtaacaactatctttgtgtattttatgactgtgtgtgtttgcactcattgcaataaagtaggacaaaatgattttgaaatgcatacatcttttcagcttcctgtttcatttttacatcctcagatacaaccatatcaaattggcctcagttgttcatcagtgaaaatgctcagtttggggtgataccacataaatagcagctttcagatgactccccacattgggtccagaagttctttcatataggctgaatataataaccatcctatatacagagctttatggaacacatgcagtttttatcgtccaagaacccctcaagatgtgtttggtaaatgctccaaagtcttacagctagaaaaggacaaaaccaggattcaaacccagggtttcactttctaagtttatttattcagtattctagactagaatctggggatacaatagtgaacaaaataaactttccctcaaagctaccttctgtttccatttgctgttcctttcacaattcatccttgagacctgaaacctaaagcactcagaactgatactctagttcattatcatatcagttccatttctagtaacttcagaaaaacaagaccactttcaggcctatctgcccttttaagttctgataggtctgatgatgatgtgctaaccattttgatttgtgtgtcaaatctaagcaaagaccatgtttgagtattgtctttatgaaatgacatttcggtaaattagaaacaacaataggcttgtttagcccttaaacatgttgatgaaacttttcattttcctgaaagaattatagattttggaaggtcctcttctatattatttttccaagaaggggaaaacgattcttacattttgctgtaggaaagtgtggcatgttacttcttatttaattatccaacttgccccccttctctgtggtagcatttttaatgtagtacttaaggctgttgtctcttaaaggctacaggggcattttcaccaccactagtataactttaatattatttactatatacagcatgagcaattataaaccctgaaggtaatagtggaaatgtttgaggatacattgaaatagtctctcaataatggggagactgcattatgctttgatagcaagacattttggaaaccattacaactctgtgtattttgtttcattaatgtaattacataccatctcttccacacacaccccagaatattatacatttttattttgcccaagcctgtttcagtcatcagtttgtagtcttttacttccacttgtaacttgataactgagtagaacaggggtttgctagagtatatttccctgtgcttctttaggtagttgactatgctattaagataacagtatttgcttactgataacttgagaaacagtcattttcttggtctgtgctaaattgcatctcttccagtggcagcttatttctttaacttttttgacatattaagattttaatcatggtaatactgaaattgtttcaaatttgaaagagcgaacctcagtaacttcaatgaaacaaatgggtttgtgatttctagccatgttaaatgaacacacaattaaaaggaaaaccattagtggtgcaaagagccctgtgctggaaatctcaaagtcttgctctgccacttttaggggccactgtagtaataataataatcaccctgtctacttcacagggttgttataaaagttgtcaatgataaaatggatataagtgagttttttaatgtgcagatcctttatatatttaaaagggatgttatattttacccactatatacatagaaaaatcatgcccagttatgacttccaataagaatttcaaccaaatagaatctctatatgtggatgtagtgcttgaggtctgggtcactagatggataaaaaccaagtgtacatttttttatattctaccaccagtcctgagcacagcactttgcctcagaaggttctgattcaccaagacttactacatgggaatagactgatttagctcaggagctccttttaatgcaaatatttattttgcttgctgagaacaaaggattacagtgccaataactcaagaaaaggagcaggcaagccaggtctgtagagagaaaatgaactggaaaataaagtaattctggggtgagtttgatctgcactttaattcaagtctcagaaccacgtgacatatagtgatcaaaatatactctcaattgcatattaggccttcctttggggacctgggctatttattcagcactgtcccaaattaatagctaaatgactgagcctcaaatttgccgagcccgtgtaatattggtataaatttggcaaggaaagcaaatgagaaggcaggcaaaggggtgggtgaggggaagcttgctgaagctcagtatctcaaagtgagttgtggatgcgtgtttaacactataaagaaccagtccattcttacccatgagttttattgctttctgggacctctaacccaggaccacccctgattcaccaacttctccttcttctcctctttaaatattatagttcattgtgatatgtttttcctgtatctgctctatcatgtgacctcctttcgcctgggagggcagattttctccttatctcttccatccatgtctgttcttagctaagagttccagcctcagtacagctggattaccctttggacagaagggcagacaacctcaaggtcagcagcaacagaagttgggcctagtagtcagatcacaagtgagtgtggctattcatgagaatagggtggtggtggcatttatcctgcttcccctccataaataaacctggtaattttatttttaatgttacaaaaaaagttgatgctacattaaatgttttaccctcatccattatcataaatctcatactggaggtgtgatctctcttcttgtttctttaattgaaagtaccaatgaatcgaggcctggtggatgatgcctttagagttttttgttttgttttgtttttgttttcttgaatcattgaaacttgtcatttttatctagactcttccacaaatggcaaagtcacttatctgcagaattcccagaatcttcttttgcctttgtgcacctgctaattaccccctctgaactgaatttgaaaaaattaattaaaataaccgaatcacccatgtttttgttcttgcagggtttggtgagttatgtggattaaaagaacagactatcctctctctttttttgtctttcttctccctgtccaatactgaggaagaagagggagaagggggtaaagatacataaggcttaactacccagggttatgaaaacagtttgcaaagtcttcctgtttgcttcccttttggtttttcttagtccctgtaggaaaaagtttacccctctgtgtgcgagtgtgtgtgtgtgtgtgtgtaagtagttgagtgaaaaagaatgagactgacttaaggagagtcaatatcgcatatgaatcaaaagccaacatttagctattagatagatctcagtgaaaggatatgttcaagctaagttgattaagtttattaaacttatttattaagcttgactaagcttattaaaacttctgctaggttgaagccattagtaaccatctgtagaagataacagccatgagtttcacaaatacagcagcagtgtctgctagaattgtgctgtgagccacgaatgcaaaccacatatgcaattttcaaattttctagtagctaccaaaaaggtaaaagaaaaagatgaaattaattttaataatgtatttgacttagccttatatatccaaaatgatagcatttcaatatgcaatcaatataaaaacatgaatgagctattttacatttttgtactgagtcttcaaactctagtgtgtattttatacttactatacatctccagtctcgaagtagccacatttcaagtgtataagagctgcatgtgagttggctattgtattggacagtcccattcctgtttcctagtattgataaagtcttcctaccttccttcgttgttatgggagaaaatgtaaacagaacctgcctattacacgagagctgcaatatttccccaaatgcagcccagcagtaccatgagctgccctgtggaaaaatttaatctgtgattaaataagttaggaaagttttattattttacccccttttgaagattacatggtacattaacatattaaagattgagtaaactctcctgggtaaaaaaacctgtttgacgttgtttagttgttgagttctgtgtctataagaatcctagaaattgccacaagtgtctctccataagaaaaactttgtgttttcctctctttctccactccttttggggcccatttctatttatctttgtattcagaatcacccgagagccacaatatctcttttgttctagaacaaccacctcctaaattgaaaccaacagatggctttaaagtcttgcacttggacatagatcttcagaaagtaccaaaatatataccttcctcttattctttcagaaacggtgaacactctaaaaagatgtgggggtgtggtgggggatatgtgaatgtgtatatgtgtaaacaccaaatacatacagtttcttaagtagagtaatgcaattcttgctgatgttttatttttatttttatttttttatttttttttttttttgagacggagtctcgctctgtcgcccaggctggagtgcagtggcgggatctcggctcgctgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaatatttttatattttgtgtgtggtgacaatgtacatgctttaatgtgtactgttctagtaatatgtatgaagtagctgtgacatagcagtcagttttaaagatacagactataattgactactgtcaatctttaacaagtgatctttttgcaacttggttttagtggggtctctgacgttgtccccacaagtttcattttaaaatctatgcttaagtggcagttaccaatataattaattctgctgctgaatttggttcatattgaatgtggtaacccttatatgtggatatattcaaacatgtggattgatttagatcatccgttttgtctttgttttttaggactttgctatttcaatattaaagatgtcttttgaatactgtagcagcagtagaatccctatgttcttgaaaatgcaaaatgtaacatgagttgcacatagactctctagcagtagaaatggaatattctaagtgcagaagtttggttttagaatctgttaaggaaggacggcccaatctttgaaaaggtacagctttctcaactttgaacatctgggggaactcttcttggaagtctgaattttaatatctttaatccaatggctctaaattaacaaacattaaaaaatggatttcgtagaatcaaattattagggggagcactttgcaaagccatatactggtgaatatatactgggtcaagcaccacatgttagttttggaatgtgtatttcccagcgaatagaatttactgctccaaaaagcttttttggcataaatcacaatacttacagaaatataattgtatcattgaaaaaaacaaagctcaccttcctaatgatacatttcacaaactgcacattagggcaatttcttacttatgaggaggtacaaagaaatactctgtcaatatagtataactgcttatttcaaattgtatctaggaatgaataactactattatttaaagtactactgaattttgaggaactgatcaaagaattagtattattaataaaattgtactatttgcaatatatttgccttggcacaaatgcagagttaaaaacataaaattataaaaaaaaataatagtgattggttgttactactttaaaatcctactaatttccattagcactaaatcaaacagcacttatctgttgtatacaagtaaaattttgaaagactcggacacaaaatgaaaggctttttaaaaatgtctttgccataacaggttatatgacctcttgctaattgttatatttccttaggggcactttgaggctctttcaaagacatctgcagcaattaggtctaaatttagagtagaatattttgccagatattttactatatcacaaaatgtcatactactgtattttataataaaaccaaattctcaagtattctggtatgttacatattaatataccaaaacatcactttctataagtctattattatgtacataatatttttaaaaataatgggtattttggtcctagtgaaaaagtataatgcaatacatgacattaatctttagtcaaaacccattgaggtgtctgacagggaaattagcaatcataagctataagatatatattattttcaaggacaaaatggcaaatgataatacagaaagacgtgatcactggagcaagttagctggtgtgcagactaagaaggatcaacttgcaaatgctcatcagaatttagcttttgttattggttgttctgcaggggatagtactagtcagttgatattgcttccctttcatgtgggagtttgctcacagcccactgcatggtataatgaaatctctataagcaagatagagtcagaagcttagagatgcactttatggtttttacaactgctgttacaatgttctaaacactgtgatctttccaaatgtgttttctgtattcgttttgtactgtagaaaataattcgctataaactggactttatagtgtttaaagcgatgttatttattggcttattgcccctccttataatacatttatgtacagtacacttaatgtaaaacctgtgataatcctttgccttaaaataaaatctaatgctaaata

SEQ ID NO: 147465 - DNA, 1469 bp, Homo sapiens
  Payload ID: 9168
  Gene Symbol: LANCL3
  Gene Name: LanC lantibiotic synthetase component C-like 3 (bacterial)
  Uniprot ID: Q6ZV70
  ENST ID: ENST00000614025
  CDS Start-End: 303-1469
aagctgcggcggcgcaggagggggcgggttcagcgagggcgcggcctctgagggggggcgcaggacacgcatcccccgcgatcgcccgggccactcgggagcctcgcggcagcccggcgccccacttggccatccgctccttgcccgcctcctcttgtcacctcccgtctcatccttctcgctccttccccgccgcatacaccggcatccgagtgcctcagagagccggaggtggtgtgcggggctgcagggcacgacttcaagcggtcctcagctccgcactagggggcacgggcaacagcatggacaccaagcgctgcttcgccaatcgcttcgatgactaccagggcagcctgctggcgggccagtgtgaggaggcggtggcgcccttggtcaccgccaccatcgagcgcatcctccaggagcttcccccactcgggggcggcgcggaggcccgaggggcgacggcgggggctagcgcctgccagggggggctttatggcggcgtggccggagtggcgtatatgctctaccacgtctcgcagagcccgcttttcgccacggcccgggaacgctacctgcgctcggctaagcgcctcatcgacgcgtgcgcccgcgctgaggagtggggcgaaccggacgccgacacccgcgccgccttcctgctcgggggcgcgggcgtgtacgccgtggccacgctcgtataccacgccctgggccggtccgactacgtgcagccgctgggcaagttccgggctctgtgtgccgtctgcgcgccggtctccttcctggagtgcggctccgacgagctgttcgtgggccgcgcgggttacctgtgtgccgcgctggtgctcaagcagaaactcgcccaggaggtgctgactccagcacagatcaagtcaatttgtcaggcaattctggactctgggaagcagtatgccataaagaagaggaaaccattccccctgatgtattcttactatggaaccgaatacttgggggcagctcacggcttgtcgtctattcttcagatgcttctttcttaccatgagcatctcaagccctcagatcgggaattggtatggcagagcgtggactttctcatggaacaggaacaaaactgcaactggccacctgagctcggcgagaccatcgagagagagaatgagctggtgcactggtgccatggcgctccaggaattgcctatctgtttgccaaagcttatctggtttccaagaaaccgcagtacctggacacatgtattcggtgtggggaactcacatggcagaaaggcctgctaaagaaggggcctgggatttgccatggagtagccggcagtgcctatgtcttcctgctgctgtaccggctcacgggaaactctaaatacatctaccgagctcaaagttcattccctgtaaacttgataaagatggaacatctgctgtataccagacaacattgcttttaa

SEQ ID NO: 147466 - DNA, 2995 bp, Homo sapiens
  Payload ID: 9169
  Gene Symbol: LSS
  Gene Name: lanosterol synthase (2,3-oxidosqualene-lanosterol cyclase)
  Uniprot ID: P48449
  ENST ID: ENST00000356396
  CDS Start-End: 78-2276
gggcggggctgggcggcaggtcccgggtgcggacatctggcagctggcagtgggcggcgtagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccatggccttcaagtcacaggacgcagcgattccctgccctcttcggtgttattacacaggcaggacttcagtgtcagtatccctgccttcagtcttctttagaaatcacatctgtgttcaatccattgtttagagggagtgtatttttcctgttccacgaagaggactttttgttcacaattggatcacaatgcagaggagtctgttcctcccccgtcggcttctcggtgctgggagggtgacctgtcccagatgactcatcaccctgacatgctcttgacaaaggacaccaccaagaggagatggcagctgtaccggtgcagcctctgtctgagggggatatttgcctcagtgtgattaaaaatcagtcatgaaagatttttgaattcagattatttttatcaggaacagattttgaacatcctgaaatcttttccctggcatcatattaggttttctttgttcactatgatgtaaagtttcagactcttgatatttttaatatcaacatagacggtaggacaaggaacggtaccagaaatgagtaaagagacaataatgataagatcgatttatcaagacataacaaccccaaatgtatatgcactaaataacagcttcaaaatacatgaagcaaaatggcagaattgaagagaatgagataaaaacagaattttaacggg

SEQ ID NO: 147467 - DNA, 4936 bp, Homo sapiens
  Payload ID: 9169
  Gene Symbol: LSS
  Gene Name: lanosterol synthase (2,3-oxidosqualene-lanosterol cyclase)
  Uniprot ID: P48449
  ENST ID: ENST00000397728
  CDS Start-End: 80-2278
aggggcggggctgggcggcaggtcccgggtgcggacatctggcagctggcagtgggcggcgtagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcacccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcagtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttatcagaagcctgtcacactgtgtttcgtttcatcctggggagaactgcagatttggggtttctggctgtcatacgtcacctgcctgtggggcgagtgggaggcccagcctggtttagggaacaagagtgacgtgaggagtagcagggtgcgtctccagttacctgagggaaaacagatattttaagagataatagcatagcctattttaatatgttttaaaggccataagcatatccaggaagataaataaacgtgatacaatgtccacataggaggaactttctttcactgcattgttttccttcacagtggccttcaagtcacaggacgcagcgattccctgccctcttcggtgttattacacaggcaggacttcagtgtcagtatccctgccttcagtcttctttagaaatcacatctgtgttcaatccattgtttagagggagtgtatttttcctgttccacgaagaggactttttgttcacaattggatcacaatgcagaggagtctgttcctcccccgtcggcttctcggtgctgggagggtgacctgtcccagatgactcatcaccctgacatgctcttgacaaaggacaccaccaagaggagatggcagctgtaccggtgcagcctctgtctgagggggatatttgcctcagtgtgattaaaaatcagtcatgaaaga

SEQ ID NO: 147468 - DNA, 853 bp, Homo sapiens
  Payload ID: 9169
  Gene Symbol: LSS
  Gene Name: lanosterol synthase (2,3-oxidosqualene-lanosterol cyclase)
  ENST ID: ENST00000450351
  CDS Start-End: 68-853
cggcgtagagcactgcagcagcaatgacggagggcacgtgagtcccctcgccccgggctcctgacgaatgcggggtggtcctaggtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccag

SEQ ID NO: 147469 - DNA, 4390 bp, Homo sapiens
  Payload ID: 9169
  Gene Symbol: LSS
  Gene Name: lanosterol synthase (2,3-oxidosqualene-lanosterol cyclase)
  Uniprot ID: P48449
  ENST ID: ENST00000457828
  CDS Start-End: 452-2410
aggggcggggctgggcggcaggtcccgggtgcggacatctggcagctggcagtgggcggcgtagagcactgcagcagcaatgacggagggcacgtgagtcccctcgccccgggctcctgacgaatgcggggtggtcctaggtgctgaggagagcgcgactggggcagtgggccggcggccggcgttggggcggggcctgggtcgctgatggccggtggtcctcaggtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcacccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcagtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttatcagaag

SEQ ID NO: 147470 - DNA, 517 bp, Homo sapiens
  Payload ID: 9169
  Gene Symbol: LSS
  Gene Name: lanosterol synthase (2,3-oxidosqualene-lanosterol cyclase)
  ENST ID: ENST00000419093
  CDS Start-End: 1-409
tgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcagtggccttcaagtcacaggacgcagcgattccctgccctcttcggtgttattacacaggcaggacttcagtgtcagtatccctgccttcagtcttctttagaaatcacatctgtgttcaatccattgtttagagggagtgtatttttcctgttccacgaagaggactttttgttcacaattggatcacaatgcagaggagtctgttcctcccccgtcggcttctcggtgctgggagggtgacctgtcccagatgactcatcaccctgacatgctcttgacaaaggacaccaccaagaggagatggcagctgtaccggtgcagcctctgtctgagggggatatttgcctc

SEQ ID NO: 147471 - DNA, 2523 bp, Homo sapiens
  Payload ID: 9169
  Gene Symbol: LSS
  Gene Name: lanosterol synthase (2,3-oxidosqualene-lanosterol cyclase)
  Uniprot ID: P48449
  ENST ID: ENST00000522411
  CDS Start-End: 37-2202
agctggcagtgggcggcgtagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctagga

SEQ ID NO: 147472 - DNA, 4307 bp, Homo sapiens
  Payload ID: 9169
  Gene Symbol: LSS
  Gene Name: lanosterol synthase (2,3-oxidosqualene-lanosterol cyclase)
  ENST ID: ENST00000630761
  CDS Start-End: 1-1649
gtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcacccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcagtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttatcagaagcctgtcacactgtgtttcgtttcatcctggggagaactgcagatttggggtttctggctgtcatacgtcacctgcctgtggggcgagtgggaggcccagcctggtttagggaacaagagtgacgtgaggagtagcagggtgcgtctccagttacctgagggaaaacagatattttaagagataatagcatagcctattttaatatgttttaaaggccataagcatatccaggaagataaataaacgtgatacaatgtccacataggaggaactttctttcactgcattgttttccttcacagtggccttcaagtcacaggacgcagcgattccctgccctcttcggtgttattacacaggcaggacttcagtgtcagtatccctgccttcagtcttctttagaaatcacatctgtgttcaatccattgtttagagggagtgtatttttcctgttccacgaagaggactttttgttcacaattggatcacaatgcagaggagtctgttcctcccccgtcggcttctcggtgctgggagggtgacctgtcccagatgactcatcaccctgacatgctcttgacaaaggacaccaccaagaggagatggcagctgtaccggtgcagcctctgtctgagggggatatttgcctcagtgtgattaaaaatcagtcatgaaaga

SEQ ID NO: 147473 - DNA, 2368 bp, Homo sapiens
  Payload ID: 9169
  Gene Symbol: LSS
  Gene Name: lanosterol synthase (2,3-oxidosqualene-lanosterol cyclase)
  ENST ID: ENST00000630343
  CDS Start-End: 1-1649
gtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccatggccttcaagtcacaggacgcagcgattccctgccctcttcggtgttattacacaggcaggacttcagtgtcagtatccctgccttcagtcttctttagaaatcacatctgtgttcaatccattgtttagagggagtgtatttttcctgttccacgaagaggactttttgttcacaattggatcacaatgcagaggagtctgttcctcccccgtcggcttctcggtgctgggagggtgacctgtcccagatgactcatcaccctgacatgctcttgacaaaggacaccaccaagaggagatggcagctgtaccggtgcagcctctgtctgagggggatatttgcctcagtgtgattaaaaatcagtcatgaaagatttttgaattcagattatttttatcaggaacagattttgaacatcctgaaatcttttccctggcatcatattaggttttctttgttcactatgatgtaaagtttcagactcttgatatttttaatatcaacatagacggtaggacaaggaacggtaccagaaatgagtaaagagacaataatgataagatcgatttatcaagacataacaaccccaaatgtatatgcactaaataacagcttcaaaatacatgaagcaaaatggcagaattgaagagaatgagataaaaacagaattttaacggg

SEQ ID NO: 147474 - DNA, 1970 bp, Homo sapiens
  Payload ID: 9169
  Gene Symbol: LSS
  Gene Name: lanosterol synthase (2,3-oxidosqualene-lanosterol cyclase)
  ENST ID: ENST00000625576
  CDS Start-End: 1-1649
gtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctagga

SEQ ID NO: 147475 - DNA, 517 bp, Homo sapiens; identical to SEQ ID NO: 147470
  Payload ID: 9169
  Gene Symbol: LSS
  Gene Name: lanosterol synthase (2,3-oxidosqualene-lanosterol cyclase)
  ENST ID: ENST00000627118
  CDS Start-End: 1-409

SEQ ID NO: 147476 - DNA, 233 bp, Homo sapiens
  Payload ID: 9169
  Gene Symbol: LSS
  Gene Name: lanosterol synthase (2,3-oxidosqualene-lanosterol cyclase)
  ENST ID: ENST00000625922
  CDS Start-End: 1-233
gtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccag

SEQ ID NO: 147477 - DNA, 3572 bp, Homo sapiens
  Payload ID: 9170
  Gene Symbol: LSG1
  Gene Name: large 60S subunit nuclear export GTPase 1
  Uniprot ID: Q9H089
  ENST ID: ENST00000265245
  CDS Start-End: 316-2292
tctcgccggacgctaaagaccgacgcacaaattaagaatggaccattcttttaactcagtcatttatccaaactcgagacattcgccaggaaatctatcgaaaatttcccagaaccattttttcacttatattctataatactggtaaaatcgagacgtaaaaggagaacttgagaacaagtcattctgctttcccctctcaagtttgagcctgaactacttgggctcgcttatcgtcacttccggggatcgaactgtgaatcccggaaactgcacgcgccgagccgggaagcttcgtccagcggtcgtgttgccatgggccggaggagagccccggccggtgggtcgctgggacgggcccttatgcgccatcagactcagcggagccgaagccatcgtcacactgactcctggttgcacacaagtgaactcaatgatggctatgattggggtcgtcttaatcttcagtcagtgactgaacagagctcccttgatgacttccttgctactgcagaacttgcaggaacagagtttgtagctgagaaacttaatattaagtttgtgcctgctgaggctagaactggactactgtctttcgaggagagccagagaattaagaagctccatgaagaaaacaaacagttcttgtgtataccgaggagaccaaactggaaccaaaatactaccccagaagaactcaaacaagcagagaaagataactttctagaatggagacgtcagcttgtccggctagaagaggaacagaagctgatattgactccatttgaacgaaatttggacttttggcgccagctctggagagtcattgagagaagtgatattgtggtccagatagtagatgctcgaaacccactcctgtttagatgtgaggatttggaatgttatgtgaaagaaatggatgccaataaggagaacgtcattctgatcaacaaggcagacttgctgactgctgagcagcggagtgcctgggccatgtacttcgaaaaagaagatgtgaaggttattttctggtcagctttggccggagccattcccctgaatggtgactctgaggaagaggcaaacagagatgatagacaaagcaacacaaccaagtttggacattccagtttcgaccaggctgaaatttcccacagtgaatccgaacatctcccagctagggattctccttcacttagtgaaaatcccacaacggatgaagatgacagtgagtatgaggactgtccagaggaggaggaagacgactggcagacgtgctcagaagaagacggtcccaaggaagaggactgcagccaggactggaaggaaagctctactgcagattctgaggctcggagcaggaaaaccccacagaagaggcagatacacaattttagccatctggtatccaagcaggagttactggagctctttaaggagctacacactgggagaaaggtgaaagatgggcaacttacggtcggactggtgggctaccctaatgttggtaagagttcaacaatcaacaccatcatgggcaacaagaaagtatctgtgtctgccacacctggtcacacaaagcactttcagactctctatgtggagcctggcctctgcctgtgtgactgtcctggcttggtgatgccatcttttgtgtctaccaaggcagaaatgacttgcagcggaatcctcccaattgatcagatgagagatcatgttcctcctgtatcactagtttgccagaatattccaagacatgttttagaagctacctatggcattaacatcataacgcctagagaggatgaagatccccaccgacctccaacatcggaagaactgttgacagcttatggatacatgcgaggattcatgacagcgcatggacagccagaccagcctcgatctgcgcgctacatcctgaaggactatgtcagtggtaagctgctgtactgccatcctcctcctggaagagatcctgtaacttttcagcatcaacaccagcgactcctagagaacaaaatgaacagtgatgaaataaaaatgcagctaggcagaaataaaaaagcaaagcagattgaaaatatcgttgacaaaacttttttccatcaagagaatgtgagggctttgaccaaaggagtccaggctgtgatgggttacaagcccgggagtggtgtagtgactgcatccactgcgagctctgagaacggggcggggaagccctggaaaaaacatggcaacagaaataaaaaagaaaaaagtcgtagactctacaagcacctggatatgtgaggttgggctgcaacagaaatgtcatctgcattgtgcagatggaaaagagcagaagctgcctgttgcctgtggaaccgtcccaagacactagcactgtagaacgggccctgctcttgcagagcacggctgcacccaacagtctccatgtcaagaccaagggcctcctggaaacaccaactctgacaaaaaggagtcatctgggagcccgagaatcctactcctggccgggcacagtggctcacgcaccaacatggagaaaccccgtctctactaaaaatacaaaaaaattagccaggcgtggtggcgcgcacctgtaatcccagctactcgggaggctgaggcaggagaatcacttgaaccagggaggcagagtttgcagtgaatggagattgcgccgctgcactccagcctgggcgacagagtgagactgcatcacaagaaaaaaaatttgcaagggatggttcacgagacacatttgggacgaaggtgaaagagaaattccccattctgagtgtcctagttgggttcctccgactctaaacaagggacttgggttcagttagtgtacagcgggggctcacgtccactaaggaacatgtagaatgtaaccaccgggtgacagggaagctgcggtatttactacctagcccccatcttcactggttattccacttatttaaaatgtccagaataagcaaatctccatatagaggaagtagattagtggttgcttcgggatgggaggaatgggaagattgaggtctttcttttgcagtgataaaaatgtcctaaaattgactgtagcgatggtcacacaactctgaatatgcttaagaccattgaattacacactttacgttggtgaattgtatggtatgtaaattatagttcaataacatagttacaaaagataatcaaaagcatgaaagcactgttgatgtggtttggatctgtgtcctcaccgagtctcatgttgaaatgtaagccccctggtgggaggcgatgggattatggggcagagtcctcacgaacggtttagcaccacccgctcagtgctgttctcctgatattgagtcctcatcacatctggttgcttcaaagtgtgtggtgcctcccctctgtctccctcctgctctggccatataagatgtgcctgcttctccttcgccttctaacatgattgtaagtttcctgaggcctccctagaagcaaaagctgctgtgcttcctgtaccatctacaggaccgtgagccaattaaacctcttttctttataaatta

SEQ ID NO: 147478 - DNA, 755 bp, Homo sapiens
  Payload ID: 9170
  Gene Symbol: LSG1
  Gene Name: large 60S subunit nuclear export GTPase 1
  ENST ID: ENST00000427461
  CDS Start-End: 1-537
atgggccggaggagagccccggccggtgggtcgctgggacgggcccttatgcgccatcagactcagcggagccgaagccatcgtcacactgactcctggttgcacacaagtgaactcaatgatggctatgattggggtcgtcttaatcttcagtcagtgactgaacagagctcccttgatgacttccttgctactgcagaacttgcaggaacagagtttgtagctgagaaacttaatattaagtttgtgcctgctgaggctagaactggactactgtctttcgaggagagccagagaattaagaagctccatgaagaaaacaaacagttcttgtgtataccgaggagaccaaactggaaccaaaatactaccccagaagaactcaaacaagcagagaaagataactttctagaatggagacgtcagcttgtccggctagaagaggaacagaagctgatattgactccatttgaacgaaatttggacttttggcgccagctctggagagtcattgagagaagtgctggacacctgtagtccccactatatttgtgagggatttgaggggcttgccaccagctgcagaaagttatcttattgctgtactttcttatacgtgatggaagaagttggacttgccattcctgcttcagccgggcaacctaatgatattgtggtccagatagtagatgctcgaaacccactcctgtttagatgtgaggatttggaatgttatgtgaaagaaatggatgcca

SEQ ID NO: 147479 - DNA, 854 bp, Homo sapiens
  Payload ID: 9170
  Gene Symbol: LSG1
  Gene Name: large 60S subunit nuclear export GTPase 1
  ENST ID: ENST00000437613
  CDS Start-End: 1-854
agtttggacattccagtttcgaccaggctgaaatttcccacagtgaatccgaacatctcccagctagggattctccttcacttagtgaaaatcccacaacggatgaagatgacagtgagtatgaggactgtccagaggaggaggaagacgactggcagacgtgctcagaagaagacggtcccaaggaagaggactgcagccaggactggaaggaaagctctactgcagattctgaggctcggagcaggaaaaccccacagaagaggcagatacacaattttagccatctggtatccaagcaggagttactggagctctttaaggagctacacactgggagaaaggtgaaagatgggcaacttacggtcggactggtgggctaccctaatgttggtaagagttcaacaatcaacaccatcatgggcaacaagaaagtatctgtgtctgccacacctggtcacacaaagcactttcagactctctatgtggagcctggcctctgcctgtgtgactgtcctggcttggtgatgccatcttttgtgtctaccaaggcagaaatgacttgcagcggaatcctcccaattgatcagatgagagatcatgttcctcctgtatcactaatcataacgcctagagaggatgaagatccccaccgacctccaacatcggaagaactgttgacagcttatggatacatgcgaggattcatgacagcgcatggacagccagaccagcctcgatctgcgcgctacatcctgaaggactatgtcagtggtaagctgctgtactgccatcctcctcctggaagagatcctgtaacttttcagcatcaacaccagcgactcctagagaac

SEQ ID NO: 147480 - DNA, 4256 bp, Homo sapiens
  Payload ID: 9171
  Gene Symbol: LATS1
  Gene Name: large tumor suppressor kinase 1
  Uniprot ID: O95835
  ENST ID: ENST00000253339
  CDS Start-End: 229-3621
aacccctatatcaatggacttttcctctaatacatggtactgctgtattaaccactttatagctttcctttctttctttcttttacagagttaattatttatattgtaaagaattttaacagtcctggggacttccttgaaggatcattttcacttttgctcagaagaaagctctggatctatcaaataaagaagtccttcgtgtgggctacatatatagatgttttcatgaagaggagtgaaaagccagaaggatatagacaaatgaggcctaagacctttcctgccagtaactatactgtcagtagccggcaaatgttacaagaaattcgggaatcccttaggaatttatctaaaccatctgatgctgctaaggctgagcataacatgagtaaaatgtcaaccgaagatcctcgacaagtcagaaatccacccaaatttgggacgcatcataaagccttgcaggaaattcgaaactctctgcttccatttgcaaatgaaacaaattcttctcggagtacttcagaagttaatccacaaatgcttcaagacttgcaagctgctggatttgatgaggatatggttatacaagctcttcagaaaactaacaacagaagtatagaagcagcaattgaattcattagtaaaatgagttaccaagatcctcgacgagagcagatggctgcagcagctgccagacctattaatgccagcatgaaaccagggaatgtgcagcaatcagttaaccgcaaacagagctggaaaggttctaaagaatccttagttcctcagaggcatggcccgccactaggagaaagtgtggcctatcattctgagagtcccaactcacagacagatgtaggaagacctttgtctggatctggtatatcagcatttgttcaagctcaccctagcaacggacagagagtgaaccccccaccaccacctcaagtaaggagtgttactcctccaccacctccaagaggccagactccccctccaagaggtacaactccacctcccccttcatgggaaccaaactctcaaacaaagcgctattctggaaacatggaatacgtaatctcccgaatctctcctgtcccacctggggcatggcaagagggctatcctccaccacctctcaacacttcccccatgaatcctcctaatcaaggacagagaggcattagttctgttcctgttggcagacaaccaatcatcatgcagagttctagcaaatttaactttccatcagggagacctggaatgcagaatggtactggacaaactgatttcatgatacaccaaaatgttgtccctgctggcactgtgaatcggcagccaccacctccatatcctctgacagcagctaatggacaaagcccttctgctttacaaacagggggatctgctgctccttcgtcatatacaaatggaagtattcctcagtctatgatggtgccaaacagaaatagtcataacatggaactatataacattagtgtacctggactgcaaacaaattggcctcagtcatcttctgctccagcccagtcatccccgagcagtgggcatgaaatccctacatggcaacctaacataccagtgaggtcaaattcttttaataacccattaggaaatagagcaagtcactctgctaattctcagccttctgctacaacagtcactgcaattacaccagctcctattcaacagcctgtgaaaagtatgcgtgtattaaaaccagagctacagactgctttagcacctacacacccttcttggataccacagccaattcaaactgttcaacccagtccttttcctgagggaaccgcttcaaatgtgactgtgatgccacctgttgctgaagctccaaactatcaaggaccaccaccaccctacccaaaacatctgctgcaccaaaacccatctgttcctccatacgagtcaatcagtaagcctagcaaagaggatcagccaagcttgcccaaggaagatgagagtgaaaagagttatgaaaatgttgatagtggggataaagaaaagaaacagattacaacttcacctattactgttaggaaaaacaagaaagatgaagagcgaagggaatctcgtattcaaagttattctcctcaagcatttaaattctttatggagcaacatgtagaaaatgtactcaaatctcatcagcagcgtctacatcgtaaaaaacaattagagaatgaaatgatgcgggttggattatctcaagatgcccaggatcaaatgagaaagatgctttgccaaaaagaatctaattacatccgtcttaaaagggctaaaatggacaagtctatgtttgtgaagataaagacactaggaataggagcatttggtgaagtctgtctagcaagaaaagtagatactaaggctttgtatgcaacaaaaactcttcgaaagaaagatgttcttcttcgaaatcaagtcgctcatgttaaggctgagagagatatcctggctgaagctgacaatgaatgggtagttcgtctatattattcattccaagataaggacaatttatactttgtaatggactacattcctgggggtgatatgatgagcctattaattagaatgggcatctttccagaaagtctggcacgattctacatagcagaacttacctgtgcagttgaaagtgttcataaaatgggttttattcatagagatattaaacctgataatattttgattgatcgtgatggtcatattaaattgactgactttggcctctgcactggcttcagatggacacacgattctaagtactatcagagtggtgaccatccacggcaagatagcatggatttcagtaatgaatggggggatccctcaagctgtcgatgtggagacagactgaagccattagagcggagagctgcacgccagcaccagcgatgtctagcacattctttggttgggactcccaattatattgcacctgaagtgttgctacgaacaggatacacacagttgtgtgattggtggagtgttggtgttattctttttgaaatgttggtgggacaacctcctttcttggcacaaacaccattagaaacacaaatgaaggttatcaactggcaaacatctcttcacattccaccacaagctaaactcagtcctgaagcttctgatcttattattaaactttgccgaggacccgaagatcgcttaggcaagaatggtgctgatgaaataaaagctcatccattttttaaaacaattgacttctccagtgacctgagacagcagtctgcttcatacattcctaaaatcacacacccaacagatacatcaaattttgatcctgttgatcctgataaattatggagtgatgataacgaggaagaaaatgtaaatgacactctcaatggatggtataaaaatggaaagcatcctgaacatgcattctatgaatttaccttccgaaggttttttgatgacaatggctacccatataattatccgaagcctattgaatatgaatacattaattcacaaggctcagagcagcagtcggatgaagatgatcaaaacacaggctcagagattaaaaatcgcgatctagtatatgtttaacacactagtaaataaatgtaatgaggatttgtaaaagggcctgaaatgcgaggtgttttgaggttctgagagtaaaattatgcaaatatgacagagctatatatgtgtgctctgtgtacaatattttattttcctaaattatgggaaatccttttaaaatgttaatttattccagccgtttaaatcagtatttagaaaaaaattgttataaggaaagtaaattatgaactgaatattatagtcagttcttggtacttaaagtacttaaaataagtagtgctttgtttaaaaggagaaacctggtatctatttgtatatatgctaaataattttaaaatacaagagtttttgaaatttttttgaaagacagttttagttttatcttgctttaaccaaatatgaaacataccccctattttacagagctcttttttcccctcataaccttgtttttggtagaaaataagctagagaaattaagccatcgtgttggtgagtgttcctaggctaatgataatctgtataattcacatcctgaaactaaggaatacagggttgaaaaaatattaatatgtttgtcagaaggaaaaataatgcatttatcttcccccccaccccccgccccatggaatatt

SEQ ID NO: 147481 - DNA, 3879 bp, Homo sapiens
  Payload ID: 9171
  Gene Symbol: LATS1
  Gene Name: large tumor suppressor kinase 1
  ENST ID: ENST00000441107
  CDS Start-End: 360-767
agcaatcatttttcagcatgaagatacagcgttgctttcacttttgatctgacaattattagaaagtgaactgaagaaaatgtcagtatgcagtttcctttaaagatgggaactcgctatgttgcctgcgctggattccaactcctggactcgagcaatcctcccaccacagcctctcaagtagctgggactacaggtgcactactgcacccagccaggagttaattatttatattgtaaagaattttaacagtcctggggacttccttgaaggatcattttcacttttgctcagaagaaagctctggatctatcaaataaagaagtccttcgtgtgggctacatatatagatgttttcatgaagaggagtgaaaagccagaaggatatagacaaatgaggcctaagacctttcctgccagtaactatactgtcagtagccggcaaatgttacaagaaattcgggaatcccttaggaatttatctaaaccatctgatgctgctaaggctgagcataacatgagtaaaatgtcaaccgaagatcctcgacaagtcagaaatccacccaaatttgggacgcatcataaagccttgcaggaaattcgaaactctctgcttccatttgcaaatgaaacaaattcttctcggagtacttcagaagttaatccacaaatgcttcaagacttgcaagctgctggatttgatgaggaggatcatctgtcagtagcctgttcacccattagtcttactaagccatttctcatttaaaaatgtcgtttgaaatactgaatcctctaggacaagatatggttatacaagctcttcagaaaactaacaacagaagtatagaagcagcaattgaattcattagtaaaatgagttaccaagatcctcgacgagagcagatggctgcagcagctgccagacctattaatgccagcatgaaaccagggaatgtgcagcaatcagttaaccgcaaacagagctggaaaggttctaaagaatccttagttcctcagaggcatggcccgccactaggagaaagtgtggcctatcattctgagagtcccaactcacagacagatgtaggaagacctttgtctggatctggtatatcagcatttgttcaagctcaccctagcaacggacagagagtgaaccccccaccaccacctcaagtaaggagtgttactcctccaccacctccaagaggccagactccccctccaagaggtacaactccacctcccccttcatgggaaccaaactctcaaacaaagcgctattctggaaacatggaatacgtaatctcccgaatctctcctgtcccacctggggcatggcaagagggctatcctccaccacctctcaacacttcccccatgaatcctcctaatcaaggacagagaggcattagttctgttcctgttggcagacaaccaatcatcatgcagagttctagcaaatttaactttccatcagggagacctggaatgcagaatggtactggacaaactgatttcatgatacaccaaaatgttgtccctgctggcactgtgaatcggcagccaccacctccatatcctctgacagcagctaatggacaaagcccttctgctttacaaacagggggatctgctgctccttcgtcatatacaaatggaagtattcctcagtctatgatggtgccaaacagaaatagtcataacatggaactatataacattagtgtacctggactgcaaacaaattggcctcagtcatcttctgctccagcccagtcatccccgagcagtgggcatgaaatccctacatggcaacctaacataccagtgaggtcaaattcttttaataacccattaggaaatagagcaagtcactctgctaattctcagccttctgctacaacagtcactgcaattacaccagctcctattcaacagcctgtgaaaagtatgcgtgtattaaaaccagagctacagactgctttagcacctacacacccttcttggataccacagccaattcaaactgttcaacccagtccttttcctgagggaaccgcttcaaatgtgactgtgatgccacctgttgctgaagctccaaactatcaaggaccaccaccaccctacccaaaacatctgctgcaccaaaacccatctgttcctccatacgagtcaatcagtaagcctagcaaagaggatcagccaagcttgcccaaggaagatgagagtgaaaagagttatgaaaatgttgatagtggggataaagaaaagaaacagattacaacttcacctattactgttaggaaaaacaagaaagatgaagagcgaagggaatctcgtattcaaagttattctcctcaagcatttaaattctttatggagcaacatgtagaaaatgtactcaaatctcatcagcagcgtctacatcgtaaaaaacaattagagaatgaaatgatgcgggttggattatctcaagatgcccaggatcaaatgagaaagatgctttgccaaaaagaatctaattacatccgtcttaaaagggctaaaatggacaagtctatgtttgtgaagataaagacactaggaataggagcatttggtgaagtctgtctagcaagaaaagtagatactaaggctttgtatgcaacaaaaactcttcgaaagaaagatgttcttcttcgaaatcaagtcgctcatgttaaggctgagagagatatcctggctgaagctgacaatgaatgggtagttcgtctatattattcattccaagataaggacaatttatactttgtaatggactacattcctgggggtgatatgatgagcctattaattagaatgggcatctttccagaaagtctggcacgattctacatagcagaacttacctgtgcagttgaaagtgttcataaaatgggttttattcatagagatattaaacctgataatattttgattgatcgtgatggtcatattaaattgactgactttggcctctgcactggcttcagatggacacacgattctaagtactatcagagtggtgaccatccacggcaagatagcatggatttcagtaatgaatggggggatccctcaagctgtcgatgtggagacagactgaagccattagagcggagagctgcacgccagcaccagcgatgtctagcacattctttggttgggactcccaattatattgcacctgaagtgttgctacgaacaggatacacacagttgtgtgattggtggagtgttggtgttattctttttgaaatgttggtgggacaacctcctttcttggcacaaacaccattagaaacacaaatgaaggttatcaactggcaaacatctcttcacattccaccacaagctaaactcagtcctgaagcttctgatcttattattaaactttgccgaggacccgaagatcgcttaggcaagaatggtgctgatgaaataaaagctcatccattttttaaaacaattgacttctccagtgacctgagacagcagtctgcttcatacattcctaaaatcacacacccaacagatacatcaaattttgatcctgttgatcctgataaattatggagtgatgataacgaggaagaaaatgtaaatgacactctcaatggatggtataaaaatggaaagcatcctgaacatgcattctatgaatttaccttccgaaggttttttgatgacaatggctacccatataattatccgaagcctattgaatatgaatacattaattcacaaggctcagagcagcagtcggatgaagatgatcaaaacacaggctcagagattaaaaatcgcgatctagtatatgtttaacacactagtaaataaatgtaatgaggatttgt

SEQ ID NO: 147482 - DNA, 7517 bp, Homo sapiens
  Payload ID: 9171
  Gene Symbol: LATS1
  Gene Name: large tumor suppressor kinase 1
  Uniprot ID: O95835
  ENST ID: ENST00000543571
  CDS Start-End: 549-3941
gcgacgctcacgaacgatcagagctgcgggcgacgcaacgaagcccggaggccgcaggctgcgcgctccctcgcagcagccgggcgggcaaaagcccccagtcctcggcccccgcgcaagcgacgccgggaaatgcccacatccgggaaacctgcagcggagtgcggcggcggcgacactgagtggaaggcaaaatggcggcggcggcggcggtggcctggtgttaaggggagagccaggtcctcacgacccctgggacgggccgcgctggcccgcggcagcccccccgttcgtctccccgctctgccccaccagggatacttggggttgctgggacggactctggccgcctcagcgtccgccctcaggcccgtggccgctgtccaggagctctgctctcccctccagagttaattatttatattgtaaagaattttaacagtcctggggacttccttgaaggatcattttcacttttgctcagaagaaagctctggatctatcaaataaagaagtccttcgtgtgggctacatatatagatgttttcatgaagaggagtgaaaagccagaaggatatagacaaatgaggcctaagacctttcctgccagtaactatactgtcagtagccggcaaatgttacaagaaattcgggaatcccttaggaatttatctaaaccatctgatgctgctaaggctgagcataacatgagtaaaatgtcaaccgaagatcctcgacaagtcagaaatccacccaaatttgggacgcatcataaagccttgcaggaaattcgaaactctctgcttccatttgcaaatgaaacaaattcttctcggagtacttcagaagttaatccacaaatgcttcaagacttgcaagctgctggatttgatgaggatatggttatacaagctcttcagaaaactaacaacagaagtatagaagcagcaattgaattcattagtaaaatgagttaccaagatcctcgacgagagcagatggctgcagcagctgccagacctattaatgccagcatgaaaccagggaatgtgcagcaatcagttaaccgcaaacagagctggaaaggttctaaagaatccttagttcctcagaggcatggcccgccactaggagaaagtgtggcctatcattctgagagtcccaactcacagacagatgtaggaagacctttgtctggatctggtatatcagcatttgttcaagctcaccctagcaacggacagagagtgaaccccccaccaccacctcaagtaaggagtgttactcctccaccacctccaagaggccagactccccctccaagaggtacaactccacctcccccttcatgggaaccaaactctcaaacaaagcgctattctggaaacatggaatacgtaatctcccgaatctctcctgtcccacctggggcatggcaagagggctatcctccaccacctctcaacacttcccccatgaatcctcctaatcaaggacagagaggcattagttctgttcctgttggcagacaaccaatcatcatgcagagttctagcaaatttaactttccatcagggagacctggaatgcagaatggtactggacaaactgatttcatgatacaccaaaatgttgtccctgctggcactgtgaatcggcagccaccacctccatatcctctgacagcagctaatggacaaagcccttctgctttacaaacagggggatctgctgctccttcgtcatatacaaatggaagtattcctcagtctatgatggtgccaaacagaaatagtcataacatggaactatataacattagtgtacctggactgcaaacaaattggcctcagtcatcttctgctccagcccagtcatccccgagcagtgggcatgaaatccctacatggcaacctaacataccagtgaggtcaaattcttttaataacccattaggaaatagagcaagtcactctgctaattctcagccttctgctacaacagtcactgcaattacaccagctcctattcaacagcctgtgaaaagtatgcgtgtattaaaaccagagctacagactgctttagcacctacacacccttcttggataccacagccaattcaaactgttcaacccagtccttttcctgagggaaccgcttcaaatgtgactgtgatgccacctgttgctgaagctccaaactatcaaggaccaccaccaccctacccaaaacatctgctgcaccaaaacccatctgttcctccatacgagtcaatcagtaagcctagcaaagaggatcagccaagcttgcccaaggaagatgagagtgaaaagagttatgaaaatgttgatagtggggataaagaaaagaaacagattacaacttcacctattactgttaggaaaaacaagaaagatgaagagcgaagggaatctcgtattcaaagttattctcctcaagcatttaaattctttatggagcaacatgtagaaaatgtactcaaatctcatcagcagcgtctacatcgtaaaaaacaattagagaatgaaatgatgcgggttggattatctcaagatgcccaggatcaaatgagaaagatgctttgccaaaaagaatctaattacatccgtcttaaaagggctaaaatggacaagtctatgtttgtgaagataaagacactaggaataggagcatttggtgaagtctgtctagcaagaaaagtagatactaaggctttgtatgcaacaaaaactcttcgaaagaaagatgttcttcttcgaaatcaagtcgctcatgttaaggctgagagagatatcctggctgaagctgacaatgaatgggtagttcgtctatattattcattccaagataaggacaatttatactttgtaatggactacattcctgggggtgatatgatgagcctattaattagaatgggcatctttccagaaagtctggcacgattctacatagcagaacttacctgtgcagttgaaagtgttcataaaatgggttttattcatagagatattaaacctgataatattttgattgatcgtgatggtcatattaaattgactgactttggcctctgcactggcttcagatggacacacgattctaagtactatcagagtggtgaccatccacggcaagatagcatggatttcagtaatgaatggggggatccctcaagctgtcgatgtggagacagactgaagccattagagcggagagctgcacgccagcaccagcgatgtctagcacattctttggttgggactcccaattatattgcacctgaagtgttgctacgaacaggatacacacagttgtgtgattggtggagtgttggtgttattctttttgaaatgttggtgggacaacctcctttcttggcacaaacaccattagaaacacaaatgaaggttatcaactggcaaacatctcttcacattccaccacaagctaaactcagtcctgaagcttctgatcttattattaaactttgccgaggacccgaagatcgcttaggcaagaatggtgctgatgaaataaaagctcatccattttttaaaacaattgacttctccagtgacctgagacagcagtctgcttcatacattcctaaaatcacacacccaacagatacatcaaattttgatcctgttgatcctgataaattatggagtgatgataacgaggaagaaaatgtaaatgacactctcaatggatggtataaaaatggaaagcatcctgaacatgcattctatgaatttaccttccgaaggttttttgatgacaatggctacccatataattatccgaagcctattgaatatgaatacattaattcacaaggctcagagcagcagtcggatgaagatgatcaaaacacaggctcagagattaaaaatcgcgatctagtatatgtttaacacactagtaaataaatgtaatgaggatttgtaaaagggcctgaaatgcgaggtgttttgaggttctgagagtaaaattatgcaaatatgacagagctatatatgtgtgctctgtgtacaatattttattttcctaaattatgggaaatccttttaaaatgttaatttattccagccgtttaaatcagtatttagaaaaaaattgttataaggaaagtaaattatgaactgaatattatagtcagttcttggtacttaaagtacttaaaataagtagtgctttgtttaaaaggagaaacctggtatctatttgtatatatgctaaataattttaaaatacaagagtttttgaaatttttttgaaagacagttttagttttatcttgctttaaccaaatatgaaacataccccctattttacagagctcttttttcccctcataaccttgtttttggtagaaaataagctagagaaattaagccatcgtgttggtgagtgttcctaggctaatgataatctgtataattcacatcctgaaactaaggaatacagggttgaaaaaatattaatatgtttgtcagaaggaaaaataatgcatttatcttcccccccaccccccgccccatggaatatttaatctatttaatcttcttgcatttatttctcaagaattactggctttaaaagaagccaaagcactactagctttttttccatattggtatttttgatgctgcttccaattttaaaagggaacaaagctgccataaatcgaaatgttcaatactaaaagctaaaatatttctcaccatcctaagcagataattattttaattttcatatacttttcctgtatagtaactattttgattatatcatcaatgttacctgtttcctctttcagaacagtgctgcatatacagattgttattggcaaaggaaaatctggctatctggcaatattttacctaagcgcagattaattggtgaaaaaattaactcttaagatggccattaataattaggaaagtttacagagtggtcttagtagaaaattcaagtcctcctaatttatttaaggttcaataatgcgttcaacatgcctgttatgtataacgcttaggttctaaggaagattaaggtttcataccaaaatacatgtagcttatcttttaggaaggggaaaaaggctccattttgaccatagtaaaatttgtgttgtgttttatttccttttcttaagctccactgataagggattgtttttatcaaaagttactatttgtagattggaggcataattttagtgattttcatacttttagctttcttcgcataaaagctaattgaaaccgtatatgtagtaaaattaaaggcagagctgttgcagttgaattggagagttagggcaaagaacacttattagcccacacttcccacctttctacaggtggtcctttcagagctcagcctgaaaacccactactgtgttatcgtgcgtcttttggggttagtggttcttttgagaatctgaaggaagctgtggactcttcctagaaaaaaaaaccacacatacacatacaatgttgcatgcagtttcaagggattttggacatattgaaacctatcacaggctgtaggttatggacctctgtgccatgagaaaattgatacattaaactaagaactttgtttttaacttaccaatcactactcagcacatcttatataagctgataatttgtgatggaaaaggtctgtagcatgtgatataaggtgaccttatgaatgcctctcttgctggtacattaagttgttttaatatatcatttggaggggactgaaatgttaggctcattacaagcttgatacagaaatatttctgaaggatttctaatcagaattgtaaaacaatgtgctatcatgaaatcgcagtcttcacctcatggttcatggaacatttggttagtcccataaaatcctatgcaaaacaaagtagttcaagaatttttaggtgggtagtcacatttataaggtattcctcttactctttgggctttttcagtctgatttatttaaattttcatttagttgttttacttttggactaaggtgcaatacagtagaagataactttgttacatttatgttgtaggaaaactaaggtgctgtctcctcccccttcccttcccacaaaatctgtattccccctattgctgaaatgtaacagacactacaaattttgtattctttttttgttttttgttttgagacagggtctcactctgtcacccaggctggagggcagtggcgcttcacagctcactgcatcctcaaccttgggggctcacgcagtcctcccgcctcagcctcccaagtagctgggcatgcgccaccaagcccagctaatttttgtatctttagtagagatggggtttcgccatgttgcccaggttggtgtggaattcctgggctccagttatatgcccacctcagcctcccaaagtgctgggattacagacgtgacccaccgcgcctggcgcaaatatgtattcttttaaaatttcctctgatactataagctttttgcatttatctgaagcagtatacatgcctttggtatcagcaattttaacagtttggatatacttatcagctatcttattccaaaactacatctacttcttccagtatagaatctggtgcttcctgaccaaaaagatgagaaaaacaatgttaaaaatatagatgctttccattgaaatggagtgaaaacattggttctatatgttttcttttaaaataattttcttattaaaaacttgctgtctttattatacttaccctttttatgcatatcaatagtatttataagatgtgttctataattatgtaattgtagatactgttatgcattgtccagtgacatcataaggcaggccctactgctgtatcttttctaccttcttatttgtaatagaaactatagaatgtatgactaaaaagtcactttgagattgacttttttaaaaagttattaccttctgctgttgcaaagtgcaaaactgtgagtggaattgttttattctgacttaatgtgttagaaattagagaatacagtgggaggatttttagacattgctgctgctgttacccaaggtattttagataaaaaatttttaataaacatccctttggtatttaaagtggaacatttagcctgttcattttaatctaaagcaaaaagtaatttgggtcaaaatattggtatatttgtaaagcgccttaatatatccctttgtggaaggcactacacagtttacttttatattgtattgtgtatataagtattttgtattaaaattgaatcagtggcaacattaaagttttataaaatcatgctttgttagaaaaagaattacagctttgcaatataactaattgtttcgcataattctgaatgtaatagatatgaataatcagcctgtgtttttaatgaacttatttgtattttcccaatcattttctctagtgtaatgtttgctgggataataaaaaaaattcaaatctttcaa

SEQ ID NO: 147483 - DNA, 602 bp, Homo sapiens
  Payload ID: 9171
  Gene Symbol: LATS1
  Gene Name: large tumor suppressor kinase 1
  ENST ID: ENST00000458696
  CDS Start-End: 1-602
gttaaggggagagccaggtcctcacgacccctgggacgggccgcgctggcccgcggcagcccccccgttcgtctccccgctctgccccaccagggatacttggggttgctgggacggactctggccgcctcagcgtccgccctcaggcccgtggccgctgtccaggagctctgctctcccctccaggatatggttatacaagctcttcagaaaactaacaacagaagtatagaagcagcaattgaattcattagtaaaatgagttaccaagatcctcgacgagagcagatggctgcagcagctgccagacctattaatgccagcatgaaaccagggaatgtgcagcaatcagttaaccgcaaacagagctggaaaggttctaaagaatccttagttcctcagaggcatggcccgccactaggagaaagtgtggcctatcattctgagagtcccaactcacagacagatgtaggaagacctttgtctggatctggtatatcagcatttgttcaagctcaccctagcaacggacagagagtgaaccccccaccaccacctcaagtaaggagtgttactcctccaccacctccaagaggccagac

SEQ ID NO: 147484 - DNA, 1096 bp, Homo sapiens
  Payload ID: 9171
  Gene Symbol: LATS1
  Gene Name: large tumor suppressor kinase 1
  ENST ID: ENST00000542720
  CDS Start-End: 317-724
gagccaggtcctcacgacccctgggacgggccgcgctggcccgcggcagcccccccgttcgtctccccgctctgccccaccagggatacttggggttgctgggacggactctggccgcctcagcgtccgccctcaggcccgtggccgctgtccaggagctctgctctcccctccagagttaattatttatattgtaaagaattttaacagtcctggggacttccttgaaggatcattttcacttttgctcagaagaaagctctggatctatcaaataaagaagtccttcgtgtgggctacatatatagatgttttcatgaagaggagtgaaaagccagaaggatatagacaaatgaggcctaagacctttcctgccagtaactatactgtcagtagccggcaaatgttacaagaaattcgggaatcccttaggaatttatctaaaccatctgatgctgctaaggctgagcataacatgagtaaaatgtcaaccgaagatcctcgacaagtcagaaatccacccaaatttgggacgcatcataaagccttgcaggaaattcgaaactctctgcttccatttgcaaatgaaacaaattcttctcggagtacttcagaagttaatccacaaatgcttcaagacttgcaagctgctggatttgatgaggaggatcatctgtcagtagcctgttcacccattagtcttactaagccatttctcatttaaaaatgtcgtttgaaatactgaatcctctaggacaagatatggttatacaagctcttcagaaaactaacaacagaagtatagaagcagcaattgaattcattagtaaaatgagttaccaagatcctcgacgagagcagatggctgcagcagctgccagacctattaatgccagcatgaaaccagggaatgtgcagcaatcagttaaccgcaaacagagctggaaaggttctaaagaatccttagttcctcagaggcatggcccgccactaggagaaagtgtggcctatcattctgagagtcccaactcacagacagatgtaggaagacctttgtctggatctggtatatcagcatttgttcaagctcacccta

SEQ ID NO: 147485 - DNA, 2567 bp, Homo sapiens
  Payload ID: 9171
  Gene Symbol: LATS1
  Gene Name: large tumor suppressor kinase 1
  Uniprot ID: O95835
  ENST ID: ENST00000392273
  CDS Start-End: 398-2470
ctgcagcggagtgcggcggcggcgacactgagtggaaggcaaaatggcggcggcggcggcggtggcctggtgttaaggggagagccaggtcctcacgacccctgggacgggccgcgctggcccgcggcagcccccccgttcgtctccccgctctgccccaccagggatacttggggttgctgggacggactctggccgcctcagcgtccgccctcaggcccgtggccgctgtccaggagctctgctctcccctccagagttaattatttatattgtaaagaattttaacagtcctggggacttccttgaaggatcattttcacttttgctcagaagaaagctctggatctatcaaataaagaagtccttcgtgtgggctacatatatagatgttttcatgaagaggagtgaaaagccagaaggatatagacaaatgaggcctaagacctttcctgccagtaactatactgtcagtagccggcaaatgttacaagaaattcgggaatcccttaggaatttatctaaaccatctgatgctgctaaggctgagcataacatgagtaaaatgtcaaccgaagatcctcgacaagtcagaaatccacccaaatttgggacgcatcataaagccttgcaggaaattcgaaactctctgcttccatttgcaaatgaaacaaattcttctcggagtacttcagaagttaatccacaaatgcttcaagacttgcaagctgctggatttgatgaggatatggttatacaagctcttcagaaaactaacaacagaagtatagaagcagcaattgaattcattagtaaaatgagttaccaagatcctcgacgagagcagatggctgcagcagctgccagacctattaatgccagcatgaaaccagggaatgtgcagcaatcagttaaccgcaaacagagctggaaaggttctaaagaatccttagttcctcagaggcatggcccgccactaggagaaagtgtggcctatcattctgagagtcccaactcacagacagatgtaggaagacctttgtctggatctggtatatcagcatttgttcaagctcaccctagcaacggacagagagtgaaccccccaccaccacctcaagtaaggagtgttactcctccaccacctccaagaggccagactccccctccaagaggtacaactccacctcccccttcatgggaaccaaactctcaaacaaagcgctattctggaaacatggaatacgtaatctcccgaatctctcctgtcccacctggggcatggcaagagggctatcctccaccacctctcaacacttcccccatgaatcctcctaatcaaggacagagaggcattagttctgttcctgttggcagacaaccaatcatcatgcagagttctagcaaatttaactttccatcagggagacctggaatgcagaatggtactggacaaactgatttcatgatacaccaaaatgttgtccctgctggcactgtgaatcggcagccaccacctccatatcctctgacagcagctaatggacaaagcccttctgctttacaaacagggggatctgctgctccttcgtcatatacaaatggaagtattcctcagtctatgatggtgccaaacagaaatagtcataacatggaactatataacattagtgtacctggactgcaaacaaattggcctcagtcatcttctgctccagcccagtcatccccgagcagtgggcatgaaatccctacatggcaacctaacataccagtgaggtcaaattcttttaataacccattaggaaatagagcaagtcactctgctaattctcagccttctgctacaacagtcactgcaattacaccagctcctattcaacagcctgtgaaaagtatgcgtgtattaaaaccagagctacagactgctttagcacctacacacccttcttggataccacagccaattcaaactgttcaacccagtccttttcctgagggaaccgcttcaaatgtgactgtgatgccacctgttgctgaagctccaaactatcaaggaccaccaccaccctacccaaaacatctgctgcaccaaaacccatctgttcctccatacgagtcaatcagtaagcctagcaaagaggatcagccaagcttgcccaaggaagatgagagtgaaaagagttatgaaaatgttgatagtggggataaagaaaagaaacagattacaacttcacctattactgttaggaaaaacaagaaagatgaagagcgaagggaatctcgtattcaaagttattctcctcaagcatttaaattctttatggagcaacatgtagaaaatgtactcaaatctcatcagcagcgtctacatcgtaaaaaacaattagagaatgaaatgatgcgggtaaaaccttttaaaatgtccatttttatacttaatcatctgtttgcttggtgtttattttaaaatattgtgtccagtatttttctttctttttatagctaaataaaatatattatcagttatggaatttaaaagtgaataaatattaaagtacttttga

SEQ ID NO: 147486 - DNA, 5511 bp, Homo sapiens
  Payload ID: 9172
  Gene Symbol: LATS2
  Gene Name: large tumor suppressor kinase 2
  Uniprot ID: Q9NRM7
  ENST ID: ENST00000382592
  CDS Start-End: 407-3673
ttgggtctgcgctttggaaccgcggcgtgagcgccccgggaagatggagcagtcgccgtccacgccaccgccgccgcccggggctcccccgtccctgcggggccagcagcagctccagccaccagtgcccggtctcccggcgcgagaggcccgggagccgccggccaggacgcccccgagggtgtagaccgcgcccctggagagagtgataatcttcaaaatgaagactttggaaaattttaggttctctataggaactacaaaaatggaaggaaagaacattttcaaaaggaaattattttgaaagtatgtttacaacaaactgatactattgacagtttttttttttaaataataaaacactttaagaagattgtatttatggtaaaaggaaactggactaacaatgaggccaaagacttttcctgccacgacttattctggaaatagccggcagcgactgcaagagattcgtgaggggttaaaacagccatccaagtcttcggttcaggggctacccgcaggaccaaacagtgacacttccctggatgccaaagtcctggggagcaaagatgccaccaggcagcagcagcagatgagagccaccccaaagttcggaccttatcagaaagccttgagggaaatcagatattccttgttgccttttgctaatgaatcgggcacctctgcagctgcagaagtgaaccggcaaatgctgcaggaactggtgaacgcaggatgcgaccaggagatggctggccgagctctcaagcagactggcagcaggagcatcgaggccgccctggagtacatcagcaagatgggctacctggacccgaggaatgagcagattgtgcgggtcattaagcagacctccccaggaaaggggctcatgccaaccccagtgacgcggaggcccagcttcgaaggaaccggcgattcgtttgcgtcctaccaccagctgagcggtaccccctacgagggcccaagcttcggcgctgacggccccacggcgctggaggagatgccgcggccgtacgtggactaccttttccccggagtcggcccccacgggcccggccaccagcaccagcacccacccaagggctacggtgccagcgtagaggcagcaggggcacacttcccgctgcagggcgcgcactacgggcggccgcacctgctggtgcctggggaacccctgggctacggagtgcagcgcagcccctccttccagagcaagacgccgccggagaccgggggttacgccagcctgcccacgaagggccagggaggaccgccaggcgccggcctcgctttcccaccccctgccgccgggctctacgtgccgcacccacaccacaagcaggccggtcccgcggcccaccagctgcatgtgctgggctcccgcagccaggtgttcgccagcgacagccccccgcagagcctgctcactccctcgcggaacagcctcaacgtggacctgtatgaattgggcagcacctccgtccagcagtggccggctgccaccctggcccgccgggactccctgcagaagccgggcctggaggcgccgccgcgcgcgcacgtggccttccggcctgactgcccagtgcccagcaggaccaactccttcaacagccaccagccgcggcccggtccgcctggcaaggccgagccctccctgcccgcccccaacaccgtgacggctgtcacggccgcgcacatcttgcacccggtgaagagcgtgcgtgtgctgaggccggagccgcagacggctgtggggccctcgcaccccgcctgggtgcccgcgcctgccccggcccccgcccccgcccccgccccggctgcggagggcttggacgccaaggaggagcatgccctggcgctgggcggcgcaggcgccttcccgctggacgtggagtacggaggcccagaccggaggtgcccgcctccgccctacccgaagcacctgctgctgcgcagcaagtcggagcagtacgacctggacagcctgtgcgcaggcatggagcagagcctccgtgcgggccccaacgagcccgagggcggcgacaagagccgcaaaagcgccaagggggacaaaggcggaaaggataaaaagcagattcagacctctcccgttcccgtccgcaaaaacagcagagacgaagagaagagagagtcacgcatcaagagctactcgccatacgcctttaagttcttcatggagcagcacgtggagaatgtcatcaaaacctaccagcagaaggttaaccggaggctgcagctggagcaagaaatggccaaagctggactctgtgaagctgagcaggagcagatgcggaagatcctctaccagaaagagtctaattacaacaggttaaagagggccaagatggacaagtctatgtttgtcaagatcaaaaccctggggatcggtgcctttggagaagtgtgccttgcttgtaaggtggacactcacgccctgtacgccatgaagaccctaaggaaaaaggatgtcctgaaccggaatcaggtggcccacgtcaaggccgagagggacatcctggccgaggcagacaatgagtgggtggtcaaactctactactccttccaagacaaagacagcctgtactttgtgatggactacatccctggtggggacatgatgagcctgctgatccggatggaggtcttccctgagcacctggcccggttctacatcgcagagctgactttggccattgagagtgtccacaagatgggcttcatccaccgagacatcaagcctgataacattttgatagatctggatggtcacattaaactcacagatttcggcctctgcactgggttcaggtggactcacaattccaaatattaccagaaagggagccatgtcagacaggacagcatggagcccagcgacctctgggatgatgtgtctaactgtcggtgtggggacaggctgaagaccctagagcagagggcgcggaagcagcaccagaggtgcctggcacattcactggtggggactccaaactacatcgcacccgaggtgctcctccgcaaagggtacactcaactctgtgactggtggagtgttggagtgattctcttcgagatgctggtggggcagccgccctttttggcacctactcccacagaaacccagctgaaggtgatcaactgggagaacacgctccacattccagcccaggtgaagctgagccctgaggccagggacctcatcaccaagctgtgctgctccgcagaccaccgcctggggcggaatggggccgatgacctgaaggcccaccccttcttcagcgccattgacttctccagtgacatccggaagcagccagccccctacgttcccaccatcagccaccccatggacacctcgaatttcgaccccgtagatgaagaaagcccttggaacgatgccagcgaaggtagcaccaaggcctgggacacactcacctcgcccaataacaagcatcctgagcacgcattttacgaattcaccttccgaaggttctttgatgacaatggctacccctttcgatgcccaaagccttcaggagcagaagcttcacaggctgagagctcagatttagaaagctctgatctggtggatcagactgaaggctgccagcctgtgtacgtgtagatgggggccaggcacccccaccactcgctgcctcccaggtcagggtcccggagccggtgccctcacaggccaatagggaagccgagggctgttttgttttaaattagtccgtcgattacttcacttgaaattctgctcttcaccaagaaaacccaaacaggacacttttgaaaacaggactcagcatcgctttcaataggcttttcaggaccttcactgcattaaaacaatatttttgaaaatttagtacagtttagaaagagcacttattttgtttatatccattttttcttactaaattatagggattaactttgacaaatcatgctgctgttattttctacatttgtattttatccatagcacttattcacatttaggaaaagacataaaaactgaagaacattgatgagaaatctctgtgcaataatgtaaaaaaaaaaaaagataacactctgctcaatgtcacggagaccattttatccacacaatggtttttgttttttattttttcccatgtttcaaaattgtgatataatgatataatgttaaaagctgctttttttggctttttgcatatctagtataataggaagtgtgagcaaggtgatgatgtggctgtgatttccgacgtctggtgtgtggagagtactgcatgagcagagttcttctattataaaattaccatatcttgccattcacagcaggtcctgtgaatacgtttttactgagtgtctttaaatgaggtgttctagacagtgtgctgataatgtattgtgcgggtgacctcttcgctatgattgtatctcttactgttttgttaaagaaatgcagatgtgtaactgagaagtgatttgtgtgtgtgtcttggttgtgattggattctttggggggggggaactgaaacatttgtcatatactgaacttatatacatcaaaagggattaatacagcgatgccaaaaagtttaatcacggacacatgtccgtttctgtagtccgtatgctctttcattcttggtagagctggtatgtggaatgccatacctctgaccctactacttacctttttactgacagactgcccacactgaaagcttcagtgaatgttcttagtcctgttttcttctgttactgtcaggaaactgagtgatctaatggttctctcactttttttttgttcttttagtgtactttgaagtatcaaatcttaacttggtttaaacaatacatattcctaacctttgtaaaaaagcaaagattcttcaaaatgacattgaaataaaaagtaagccatacgtattttcttagaagtatagatgtatgtgcgtgtatacacacacacacacacacacagagataaacacaatattccttatttcaaattagtatgattcctatttaaagtgatttatatttgagtaaaaagttcaattcttttttgctttttaaaaaatctgatgcttcataattttcattatattattccacatatttttccttgaagttcttagcataatgtatccattacttagtatatatctaggcaacaacacttagaagtttatcagtgtttaaactaaaaaaataaagattcctgtgtactggtttacatttgtgtgagtggcatactcaagtctgctgtgcctgtcgtcgtgactgtcagtattctcgctattttatagtcgtgccatgttgttactcacagcgctctgacatactttcatgtggtaggttctttctcaggaactcagtttaactattatttattgatatatcattacctttgaaaagcttctactggcacaatttattattaaaattttgaatccaaatccc

SEQ ID NO: 147487 - DNA, 2261 bp, Homo sapiens
  Payload ID: 9173
  Gene Symbol: LAS1L
  Gene Name: LAS1-like, ribosome biogenesis factor
  Uniprot ID: Q9Y4W2
  ENST ID: ENST00000374804
  CDS Start-End: 42-2069
gtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 147488 - DNA, 2386 bp, Homo sapiens
  Payload ID: 9173
  Gene Symbol: LAS1L
  Gene Name: LAS1-like, ribosome biogenesis factor
  Uniprot ID: Q9Y4W2
  ENST ID: ENST00000374807
  CDS Start-End: 40-2193
gcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgta

SEQ ID NO: 147489 - DNA, 2439 bp, Homo sapiens
  Payload ID: 9173
  Gene Symbol: LAS1L
  Gene Name: LAS1-like, ribosome biogenesis factor
  Uniprot ID: Q9Y4W2
  ENST ID: ENST00000374811
  CDS Start-End: 42-2246
gtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagatggtcagactgaggtccagagaggggaaggtactgacccaaagtcacacaaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgta

SEQ ID NO: 147490 - DNA, 5205 bp, Homo sapiens
  Payload ID: 9173
  Gene Symbol: LAS1L
  Gene Name: LAS1-like, ribosome biogenesis factor
  Uniprot ID: Q9Y4W2
  ENST ID: ENST00000484069
  CDS Start-End: 61-936
gcacgctgagctgaaggctgtgcggagcggcgcggcacagagcctgttgttgagctcagtatgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacgggaggctgtgctggatgcttttctggatgatggcttccttgtccccacatttgaacagttggcagctttgcagatagaatatgaagatggtcagactgaggtccagagaggggaaggtactgacccaaagtcacacaaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatgtaagtctcttgaattccatccggtaagagggtgaggcccttcaagcctcagggccacactgccctagaatgactgagttagaagggccctttggggacagtctagcccagtctcactcccactgacagatgggacaactgagtccagagaggggaggggtagggttttcttacctaagatcatacagcttaagacctgactgaactgagtccagtgtgggaatggataagacaatccccctagagtgcttagcacagtggcctgcacagagtaagtgcacaataaatggtagctgctgtttattattgaacccaggtcttctgactccaagcccagtgctgtttcctctattatctttccaaagtatacctctgatagttgcttagcaaccttcagttgctccctattgccttcctgttaagtctaggcttcttagcctgacattcaaagatctttctgattctggcccaacttaccatggtagccatacctcctgtgagtctcctttaccctatccaccctgggttctatggtcaaactgaatattgcactggtaaatacctgtggttgtctccctttccttttctctgtcatttcctgaccctgagccacttccctcataatcatggaagcctttagcgcctgattcccttcttgctttcttgagcaatatctgtttcatttggatgactcatctgacactctacagctcctcaactccagtgactttcattctccactacactcagcaacccatttccatcattcggagctattccacctctgaaagctcacatcccagcatcccactcggtgaccaccacttctcgtccttctagttctcacccttgcatcccatgacatctgctctttgcctgcatccagatctccatccctccatttcctgcatcccttgaccttgcttcctctctatcctgtctgtggttgctcagttcggccactcatcatcagcaccttcagctttgcccatcctttggccatatctgacttgcaaacccctgagctggaattgatcctccccattctgcttcccctgctcctcagcccgggtagctgagctctgctggagaaaaccacatagccctgcggattgctgccactgcagaggtatgatttttaatctcgggcgaggcctcagttctgcttgtctgaacttttacttgttttctgaccactttctctcccatttcctcactattctaaacccttaccgctcacctcaagcccctccccctctcccatttcaccctagcttcctcgagcacatggaggcatccggcagggccccctcgacctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcctcaaaaaatgcctgtgcttattactagttcctataaagtgctgaaacccaaatctgtctagccctggcccctcccccaagattcagcctcctgtactcgactacatgtcagacatctccccttggatggcccacaggcaccttactgtgaccaaaagagaattggtcgtctcagtccccatctcaactctaaagtgatcttcctcctctgttccctatctcacttggtggcggcaccatctaccctgtcctgttgactctcgaatacttcccaaatctgaggttttgtgttgccgtgtctacttcccttagtgtctccttccctctatcagactaagcttttcaagggcaaggactctacatcagctgtccgtgccctagcacaccacacaagtctaggcaccaaacaggcctcagtaaatgtcgttgaattgaaccgtgctctgctctctcattcccagcagtgctgtccttggtgggagctgacccagtgcctggggaatgaatgaagtgggagtctggatgccaagaccctcttagtccctgatccccctattgagtccaaaagtctttctttaaccctgatggcatttgggacacagaggtatttgtaaggttttaaaagtggctttgtagacaaagtcagtcaaggcaagacttccaggagttggaactgaacagccacattgccagatgtgtgctccagactagaagtgatgtggatgggtgggcaattgggaggagaaccaaaagggcctggatgagtcagagtttcaagaggaggcatttgaacaattcaagcaggagaaagaataaagcaagtttcaaagtccagaaggaacatggcatgtgtatataatgggagggagggagtgacaagagcagcatggagaggtttggataggtggccttcaaggtactttccaatcctaagtgcctgcagagtggaagctgctggtctcggagaagtctggaccacagagatcttctcccaacccaagcataccagagggatgcgacacatgccggcagtaacagcggctcacttggcatcttcaaagccatggggcagggcctgccagacgaggagcaggagaagctgctgcgcatctgttccatttatacccagagtggagaaaacagcctggtgcaggagggctctgaggcctcccccattgggaagtctccatatacactagacagcctgtattggagcgtcaagccagccagctccagcttcgggtctgaagcaaaggcccagcaacaggaggagcagggcagtgttaatgatgtcaaggaagaggagaaggaggagaaagaggtcttgccagaccaggtagaggaggaggaagaaaatgatgaccaagaggaggaagaggaggatgaagatgatgaagatgatgaagaggaagacagaatggaggtggggcctttctctacagggcaagagtcccccactgccgagaatgctaggcttctggcccagaaaagaggagctttgcagggctctgcatggcaggttagctcagaagacgtgcgatgggacacatttcccctaggccgaatgccaggtcagaccgaggacccagcagagctcatgctggagaattatgacaccatgtatcttttggaccagcctgtgctagagcagcggctggaaccctcaacatgcaagactgacaccttgggcctgagctgtggtgtcggcagtggcaactgcagcaacagcagcagcagcaacttcgagggccttctctggagccaggggcagctgcatgggctcaaaactggcctgcagctcttctgatggccatccctggtgcaagtgttcatccagccgtgccagggcaacagcccaccccctagtacaactgatgctccctgagacaacctgggagacagcctggatcagccacatcaactcagttgtccaccacaggggaattttgaatgtcttttgtttttgttttgttttgaaaaataataaacaggcaactgt

SEQ ID NO: 147491 - DNA, 447 bp, Homo sapiens
  Payload ID: 9173
  Gene Symbol: LAS1L
  Gene Name: LAS1-like, ribosome biogenesis factor
  ENST ID: ENST00000469091
  CDS Start-End: 1-221
ggatggttgagtcctgcttgggctcaccttgctgggccagcccccaactccttcggattgcctgcagagtggaagctgctggtctcggagaagtctggaccacagagatcttctcccaacccaagcataccagagggatgcgacacatgccggcagtaacagcggctcacttgggtacgatttcttgtgcacagatcctgcctttcccagataagcagtgaatctagtcctaatcaccccgttacacagagtggagaacagagggggtttgcccaggtattatgctgcaagtcagagctggggccagaatccagatagcctgtccttagtcccatgctcttctgtaatactccactagattgtattattgcagaaagcatctgttaaacacagaacttggcttttgttttccccagagaaaaaataaaagatactattggaaattaa

SEQ ID NO: 147492 - DNA, 422 bp, Homo sapiens
  Payload ID: 9174
  Gene Symbol: LCE1A
  Gene Name: late cornified envelope 1A
  Uniprot ID: Q5T7P2
  ENST ID: ENST00000335123
  CDS Start-End: 1-333
atgtcctgccagcagagccagcagcagtgccagccccctcccaagtgcacccccaagtgccctcccaagtgccccactcctaagtgccccccaaagtgtccccctaagtgccctccagtctcttcctgctgcagtgtcagctccggaggctgctgtggctccagctctgggggcggctgcagctctgggggaggtggctgctgcctgagccaccacaggcgccacaggtcccaccgtcacagactccagagctctggctgctgcagccagccctcgggaggctccagctgctgtggaggggacagcggccagcactctggaggctgctgctgaagcggactctgcacctagaagagcagactcgggtgaaatgagtgatcaaacatttcctcctcacctgtctcctcctgggcctgcaagag

SEQ ID NO: 147493 - DNA, 1139 bp, Homo sapiens
  Payload ID: 9175
  Gene Symbol: LCE1B
  Gene Name: late cornified envelope 1B
  Uniprot ID: Q5T7P3
  ENST ID: ENST00000360090
  CDS Start-End: 477-833
gttctgaacttctatgtccttacaacaaggtaatctagaaaattcttccaagagagaatgactgtttccccttgagaaacaattttatttccaaacccctttctagattgttttcatgattcaggtgtgtagttgaagcagaatgtctcctctacatactacatgcttgattttgagaatactttcttaatatcttttggcttcggttttctaattataaaatagttgaaaatgctttatgattttataagtatataaaaagcattaggttcaaaacagaggctataagtgtgtttagccaactattagacacaatgaaacttcccgtgattaattagctacaactacactaagcagttcatcaaaatgtagggattagaaatgatgctgaaagggcaagaataggccggggtggcctctacctgggtctaacttgctgtctgactctctctcagctcctgaacacccgcaccaagatgtcctgccagcagaaccagcagcagtgccagccccctcccaagtgcatccccaagtgccctcccaagtgcctcacccctagatgccccccaaagtgtccccctaagtgtcctccagtctcttcctgctgcagtgtcagctccggaggctgctgtggctccagctctgggggaagctgtggctccagctctgggggttgctgcagttctgggggaggtggctgctgcctgagccaccacaggcgccgtaggtcccactgccacagaccccagagctctggctgctgcagccagccctccgggggctccagctgctgtggaggagggagtggccagcactctggaggctgctgctaaagtggatcctgagcctagaagaacacaaatggccaaatatttcccttccgtcttccttctccttctgggcctgcccatgttgttgagaggtcttggtgagggctcaactcaagcatagaggattcttctgtcttggagttcagaggcccaaaacttctcccccaaagccaagccatttaatgacctcagtttgcgtatgtgtggttgctctgggaagcccaaagcacagacctatatccctttgcagcttgtctttttgcatagctcagcctgatgtgaaacaataaaaccagaaatatgcattcc

SEQ ID NO: 147494 - DNA, 644 bp, Homo sapiens
  Payload ID: 9176
  Gene Symbol: LCE1C
  Gene Name: late cornified envelope 1C
  Uniprot ID: Q5T751
  ENST ID: ENST00000607093
  CDS Start-End: 1-357
atgtcctgccagcagagccagcagcagtgccagccccctcccaagtgcacccccaagtgccctcccaagtgccccaccccaaagtgtcccccaaagtgtccccctaagtgccctcctgtctcttcctgctgcagtgtcagctccggaggctgctgtggctccagctctgggggcagctgtggctccagctctgggggatgctgcagttctgggggaggtggctgctgcctgagccaccacaggcgccgtaggtcccactgccacagaccccagagctctggctgctgcagccagccctcggggggctccagctgctgtggcggggggagtggccagcactctggaggctgctgctgaagtggaccctgagcctagaagagcagaatccaggaccgcaaactgccaaggacatcccccttctcctactaggcctgcctgagaggctcacaggtccaagggaaagctctgaacttgccaagagcatatcttttccctggagtccagaaactcagatcctctcctggatctccattcactggccttggacctcacctttgtggctaccctcccacgctctgtctaagcccctagcttactcaatgtcatttgcagcgtgcatctgctgattaaaggactaaaacaag

SEQ ID NO: 147495 - DNA, 211 bp, Homo sapiens
  Payload ID: 9176
  Gene Symbol: LCE1C
  Gene Name: late cornified envelope 1C
  ENST ID: ENST00000606576
  CDS Start-End: 49-211
gaaggaccctgtgctgcctgtgaccccgctcctgaatccgccaccaagatgtcctgccagcagagccagcagcagtgccagccccctcccaatgtcagctccggaggctgctgtggctccagctctgggggcagctgtggctccagctctgggggatgctgcagttctgggggaggtggctgctgcctgagccaccacaggcgccgtaggt

SEQ ID NO: 147496 - DNA, 430 bp, Homo sapiens
  Payload ID: 9177
  Gene Symbol: LCE1D
  Gene Name: late cornified envelope 1D
  Uniprot ID: Q5T752
  ENST ID: ENST00000326233
  CDS Start-End: 44-388
cctgtgctgcctgtgactccgctcctgaacacccaccaccgagatgtcctgccagcagagccagcagcagtgccagccccctcccaagtgcactcccaagtgcactcccaagtgccccgcccctaaatgtccccctaagtgccctccagtctcttcctgctgcagtgtcagctccggaggctgctgtggctccagctctgggggcggctgtggctccaactctgggggctgctgcagctctgggggtggtggctgctgcctgagccaccacaggcgccacaggtcccaccgtcgcagaccccagagctctgactgctgcagccagccctcggggggctccagctgctgcggtgggggcagcagccagcactctggaggctgctgctgaagtggaccttgacttcctcttccttctgattctgcctgaata

SEQ ID NO: 147497 - DNA, 1180 bp, Homo sapiens
  Payload ID: 9178
  Gene Symbol: LCE1E
  Gene Name: late cornified envelope 1E
  Uniprot ID: Q5T753
  ENST ID: ENST00000368770
  CDS Start-End: 54-410
gccgaaggaccctgtgctgcctgtgactttgctcctaagtacctactgccgagatgtcctgccagcagagccagcagcagtgccagccccctcccaagtgcactcccaagtgccctcccaagtgtcccacccccaaatgccctccaaagtgtccccctaagtgccctccagtctcttcctgctgcagtgtcagctccggaggctgctgtggctccagctctgggggcagctgtggctccagctctgggggctgctgcagctctgggggaggtggctgctgcctgagccaccacaggcaccacaggtcccaccgtcacagaccccagagctctgactgctgcagccagccctcagggggctccagctgctgtggagggggcagcggccagcactctggaggctgctgctgaagtggaccttgacttcctcttccttctgattctgcctgaatagctgagaggttccagcaaaagcttgaagtcttgcctggagaatccctctgctctggtgtcaggaaacccaaaatctttctccttaatggcatttagagactttcttctgcagatccatggctgccctgggaactccaaagcacacacctacttcctccccagctcacgctgctgtattctgtgctgcctgaactgaagaaataaaatccagaatctgccccccaacttgctaccagcctgcttgattttcctgtttgtgtcatccttgttctgctcccctgtgtctgctggtggctgctgaggccttggtggacagaggatggggaaaggggtcaggaggaaaaagcttgcatttctgtgtgttttgtgttttttcttctttcggtgttttccttttaaaccaagggactgaaatagcattgagaaatatttttctttcaaattctggttcctttcacctatgtaaccgcatccctcaggcatggccaggaggccgacttcatcctccttcccactatcacctcttcattcttgtgttcctcgttccccactccttccactaacaatctccctggactcctcctccatactgtatgtgcatgcattcacacacacatatgtacatgcacatagatgagatgaatctgcattgtaaaaaaattaaatcacatttagtgctgtataatttgcatgcaataaaattcaataaaattaaatgtaaaattaaa

SEQ ID NO: 147498 - DNA, 575 bp, Homo sapiens
  Payload ID: 9178
  Gene Symbol: LCE1E
  Gene Name: late cornified envelope 1E
  Uniprot ID: Q5T753
  ENST ID: ENST00000368771
  CDS Start-End: 173-529
gaaacccaggctgggataaaagggctcagggccagagcaccccattcactcacttcctgaggtgccgaaggaccctgtgctgcctgtgactttggtatgtgtcctctgggaacagaagcaggggattccacagagggatgctcagatcagctcctaagtacctactgccgagatgtcctgccagcagagccagcagcagtgccagccccctcccaagtgcactcccaagtgccctcccaagtgtcccacccccaaatgccctccaaagtgtccccctaagtgccctccagtctcttcctgctgcagtgtcagctccggaggctgctgtggctccagctctgggggcagctgtggctccagctctgggggctgctgcagctctgggggaggtggctgctgcctgagccaccacaggcaccacaggtcccaccgtcacagaccccagagctctgactgctgcagccagccctcagggggctccagctgctgtggagggggcagcggccagcactctggaggctgctgctgaagtggaccttgacttcctcttccttctgattctgcctgaatagctg

SEQ ID NO: 147499 - DNA, 267 bp, Homo sapiens
  Payload ID: 9178
  Gene Symbol: LCE1E
  Gene Name: late cornified envelope 1E
  ENST ID: ENST00000619588
  CDS Start-End: 1-267
atgtcctgccagcagagccagcagcagtgccagccccctcccaatgtcagctccggaggctgctgtggctccagctctgggggcagctgtggctccagctctgggggctgctgcagctctgggggaggtggctgctgcctgagccaccacaggcaccacaggtcccaccgtcacagaccccagagctctgactgctgcagccagccctcagggggctccagctgctgtggagggggcagcggccagcactctggaggctgctgctga

SEQ ID NO: 147500 - DNA, 357 bp, Homo sapiens
  Payload ID: 9179
  Gene Symbol: LCE1F
  Gene Name: late cornified envelope 1F
  Uniprot ID: Q5T754
  ENST ID: ENST00000334371
  CDS Start-End: 1-357
atgtcttgccagcagagccagcagcagtgccagccccctcccaagtgcactcccaagtgccctcccaagtgccccacaccgaagtgccccccaaagtgtccccctaagtgccctcctgtctcttcctgctgcagcgtcagctccggaggctgctgtggctccagctctgggggctgctgcagctctgggggtggtggctgctgcagctctgggggaggcggctgttgcctgagccaccacagacggcgtaggtcccaccgccacagaccccagagctctgactgctgcagccagccctcagcgggctccagctgctgcggagggggcagtggccagcactctggaggctgctgctga

SEQ ID NO: 147501 - DNA, 592 bp, Homo sapiens
  Payload ID: 9180
  Gene Symbol: LCE2A
  Gene Name: late cornified envelope 2A
  Uniprot ID: Q5TA79
  ENST ID: ENST00000368779
  CDS Start-End: 52-372
ggacgtgtctgtgctcctgtgtgtgaccagggttgaaaaagtcgcactgagatgtcctgccagcaaaaccagcagcagtgccagccccctcccaagtgccccccaaaatgcccacccaagtgtcctccaaagtgccgacctcagtgcccagccccatgcccacctccagtctcttcctgctgtggtcccagctctgggggctgctgcggctccagctctgggggctgctgcagctctgggggtggcggctgctgcctgagccaccacaggccccgtctcttccaccggcaccggcaccagagccccgattgttgtgagtgtgaaccttctgggggctctggctgctgccacagctctggggactgctgctgaccagacctcgaacatcacagagcaacccttatggagaaacttgcaaccaggacctgtcccagagtgatgcttctcctgcccctttttctcctttccttgggctgacacaccttgtgaggtgttttgtctgttgtcatggcccaagagcccatcctggatcctgatcttaccttcccactttacctcatacaacaataaagctcttttgcctcttcgtgaa

SEQ ID NO: 147502 - DNA, 612 bp, Homo sapiens
  Payload ID: 9181
  Gene Symbol: LCE2B
  Gene Name: late cornified envelope 2B
  Uniprot ID: O14633
  ENST ID: ENST00000368780
  CDS Start-End: 55-387
cagggacgtgtctgtgctcctgcgtgtgaccagggttgactaaactctgccaggatgtcttgccagcaaaaccagcagcagtgccagccccctcccaagtgtcctcccaagtgtaccccaaaatgtccacctaagtgtccccctaaatgcctgccccagtgcccagctccatgttcccctgcagtctcttcttgctgtggtcccatctctgggggctgctgtggtcccagctctgggggctgctgcaactctggggctggtggctgctgcctgagccaccacaggccccgtctcttccaccggcgccggcaccagagccccgactgctgtgagagtgaaccttctgggggctctggctgctgccacagctctgggggctgctgctgacctgggctaagaagaactctttggacagaatgtttaagaacctcctacagcctgatgcttaaccctttccatttcctctcattccattcatgggtggacagcgaccacaaagactcatggggcttccctgggagaactttgcacttgatggagcacctcaattgcaggttttgttttcctcctttacctcatgttataataaagctctgatttctgactcacaaa

SEQ ID NO: 147503 - DNA, 614 bp, Homo sapiens
  Payload ID: 9182
  Gene Symbol: LCE2C
  Gene Name: late cornified envelope 2C
  Uniprot ID: Q5TA81
  ENST ID: ENST00000368783
  CDS Start-End: 56-388
cagggacgtgtctgtgctcctgcgtgtgaccagggttgactaaactcctgccagcatgtcttgccagcaaaaccagcagcagtgccagccccctcccaagtgtcctcccaagtgtaccccaaaatgtccacctaagtgtccccccaaatgcccaccacagtgcccagctccatgtttccctgcagtctcttcttgctgtggtcccagctctgggagctgctgtggtcccagctctgggggctgctgcagctctggggctggtggctgctccctgagccaccacaggccccgtctcttccaccggcgccggcaccagagccccgactgctgtgagagtgaaccttctgggggctctggctgctgccacagctctgggggctgctgctgacctgggctacagaagagctcttgggactgaatggccaagaacctgctacggcctgatggatactctttccacttcctctcattccattcattggttggcagagaccacaaagactcatggggctttcctggaagaacttcgtgcttgatgtaacaccccaattgcaagtcttcttttcctcctttacctcatgttataataaagctctgatctctgactcactaaa

SEQ ID NO: 147504 - DNA, 609 bp, Homo sapiens
  Payload ID: 9183
  Gene Symbol: LCE2D
  Gene Name: late cornified envelope 2D
  Uniprot ID: Q5TA82
  ENST ID: ENST00000368784
  CDS Start-End: 56-388
cagggacgtgtctgtgcttttgcatgtgaccagggttgactaaactcctgccaggatgtcttgccagcaaaaccagcagcagtgccagccccctcccaaatgtcctcccaagtgtaccccaaaatgtccacctaagtgtccccccaaatgcccaccacagtgcccagctccatgttcccctgcagtctcttcctgctgtggtcccagctctgggagctgctgtggtcccagctctgggggctgctgcagctctgggggtggtggctgctgcctgagccaccacaggccccgtctcttccaccggcgccggcaccagagccccgattgctgtgagagtgaaccttctggggcctctggctgctgccacagctctgggggctgctgctgacctgggctgcagaagagctctggtactgaatggtcaaaaacctgctacagcctgatgcttaactatttccccttcctttcattccactcatgggtggacagggaccacaaagactcatggggcttccccagaactttgtgcttgatggagcaccccagatggaagccttctttttctcctttacctcatattgtaataaagctctgatttctgactcttta

SEQ ID NO: 147505 - DNA, 270 bp, Homo sapiens
  Payload ID: 9184
  Gene Symbol: LCE3A
  Gene Name: late cornified envelope 3A
  Uniprot ID: Q5TA76
  ENST ID: ENST00000335674
  CDS Start-End: 1-270
atgtcctgccagcagaaccagcagcagtgccagcctccgcccaagtgccctgcaaagagcccagcacagtgtctgcctccagcttcctccagctgtgccccaagctctgggggctgtgggcccagctccgagcgcagctgctgcctgagtcaccacagatgccgcaggtctcaccgttgccgttgccagagctccaactcctgtgacaggggaagtggtcagcaaggcgggagctccagctgtggccacagttctgcgggctgctgctga

SEQ ID NO: 147506 - DNA, 288 bp, Homo sapiens
  Payload ID: 9185
  Gene Symbol: LCE3B
  Gene Name: late cornified envelope 3B
  Uniprot ID: Q5TA77
  ENST ID: ENST00000335633
  CDS Start-End: 1-288
atgtcctgccagcagaaccagcagcagtgccagcctctgcccaagtgcccctcacccaagtgccccccaaagagctcagcacagtgtctgcctccagcctcctcctgctgtgctccaagacctgggtgctgtggtggccccagctctgagggcggctgctgcctgagccaccacaggtgctgcaggtcccaccgatgccggcgccagagctccaactcctgtgacagaggcagtggtcagcaagatggtgcctccgactgtggctatggctctggaggctgctgctga

SEQ ID NO: 147507 - DNA, 425 bp, Homo sapiens
  Payload ID: 9186
  Gene Symbol: LCE3C
  Gene Name: late cornified envelope 3C
  Uniprot ID: Q5T5A8
  ENST ID: ENST00000333881
  CDS Start-End: 71-355
ggtctgagggttctgtgctcaaatgtttctattattctgttcaaggtaaaattcctgcattcctgcaaagatgtcctgccagcaaaaccagcagcagtgccagccccctcccagttgtccctcacccaagtgtcccccaaagagcccagcacagtgtctgcctccaccctcttctgactgtgctctaagctccgggggctgtggccccagttctgaaagtggctgctgcctgagccaccacaggcacttcaggtcccatcaatgccggcgccagagatccaactcctgtgacaggggcagtggtcagcaaggcgggggctcctgccgtggccatggctctgggggctgctgctgacctggatcctgatgatgagacaagtgatctttggaggaaacaaggatcccaaaggcccaggaaaagctcc

SEQ ID NO: 147508 - DNA, 270 bp, Homo sapiens
  Payload ID: 9186
  Gene Symbol: LCE3C
  Gene Name: late cornified envelope 3C
  ENST ID: ENST00000617545
  CDS Start-End: 1-270
atgtcctgccagcagagccagcagcagtgccagcctcctcccaagtgtcccccaaagagcccagcacagtgtctgcctccaccctcttctgactgtgctctaagctccgggggctgtggccccagttctgaaagtggctgctgcctgagccaccacaggcacttcaggtcccatcaatgccggcgccagagatccaactcctgtgacaggggcagtggtcagcaaggcgggggctcctgccgtggccatggctctgggggctgctgctga

SEQ ID NO: 147509 - DNA, 613 bp, Homo sapiens
  Payload ID: 9187
  Gene Symbol: LCE3D
  Gene Name: late cornified envelope 3D
  Uniprot ID: Q9BYE3
  ENST ID: ENST00000368787
  CDS Start-End: 58-336
ctcaggaacagccttctcctgcctcctctgcacctggacaactcaactcctgccaagatgtcctgccagcagaaccagcagcagtgccaacccccacccaagtgtccctcacccaagtgtcccccaaagagcccagtacagtgtctgcctccagcttcctctggctgtgccccaagctctgggggctgtggccctagctccgagggcggctgcttcctgaaccaccacaggcgccaccaccgatgccggcgccagaggcccaactcctgtgacaggggcagtggtcagcaaggcgggggctctggctgcggccatggctctggaggctgctgctgacctggatcctgatgctgagacaagcgattttggaggaaacaagaatcccaagggcccaggaaaaccccatcttgatgcatgagttcccagataccctcttctggctttcacaggctgagctaggggttttcctgtggaaggtctgagctctccccagaaggcacttcctgtctgatgtccaggatgtcacatgttcccttacccctgtacctgtgaaggattggcagtgcttgtgcctgacctcatcaaaaaataaagctccttgtcctcattacca

SEQ ID NO: 147510 - DNA, 611 bp, Homo sapiens
  Payload ID: 9188
  Gene Symbol: LCE3E
  Gene Name: late cornified envelope 3E
  Uniprot ID: Q5T5B0
  ENST ID: ENST00000368789
  CDS Start-End: 57-335
ctcaggaacagccttctcctgcctctctgcacctggacatctcaactcctgccaagatgtcctgccagcagaaccagaagcagtgccaacccccacccaagtgcccctcacccaagtgtcccccaaagaacccagtacagtgtctgcctccagcttcctctggctgtgccccaagctctgggggctgtggccctagctccgagggcggctgcttcctgaaccaccacaggcgccaccaccgatgccggcgccagaggtccaactcctgtgacaggggcagtggtcagcaaggcgggggctctggctgctgccacggttctgggggctgctgctgatccagatcctgatgctgagacaagcgatctttggaggaaacaagaatcccaagaggccaagaacagccccatctgacgcatgccttcccatataccctcttctgactttcacaggctgagctggaggttttcctgtgggggatctgagctctccccagaaggcacttcttgttttatgtacaggatgtcatatgtccccctacccctgtacctgccaaggattggcagtgcttgtgcccaacctcgtaaaaaagataaagttccttgtcctcatta

SEQ ID NO: 147511 - DNA, 388 bp, Homo sapiens
  Payload ID: 9189
  Gene Symbol: LCE4A
  Gene Name: late cornified envelope 4A
  Uniprot ID: Q5TA78
  ENST ID: ENST00000335535
  CDS Start-End: 30-329
tcattcaggtttatcgaaatcccaccaagatgtcctgccagcagaaccaacagcagtgccagccccctcccaagtgtcctatccccaagtatcccccaaaatgtccctcaaagtgtgcatcctcatgcccacctccaatctcttcctgctgtggctccagctctgggggctgtggttgctgcagctctgagggaggtggctgctgcctgagccaccacagacaccataggtcccactgccacagacccaagagctccaattgctatggcagtggcagtggccagcagtctgggggttctggctgctgctctggagggggctgttgctgacctggaccaggagcagcaccaaaggaattagtgggcgaaggacccattgcagcctggtg

SEQ ID NO: 147512 - DNA, 672 bp, Homo sapiens
  Payload ID: 9189
  Gene Symbol: LCE4A
  Gene Name: late cornified envelope 4A
  Uniprot ID: Q5TA78
  ENST ID: ENST00000368777
  CDS Start-End: 257-556
tgccgaagaggctatctgggaagctcatcatccagctcaggaagagatgaaaccaggaggcaggagaatgtcaggcatgaccccacacttgtgcaacagccacgtcctgctcctgccattagcatggctcatccgaggcccagccccaggatccatacaaagtgtgttcctgctgctggcttctcatctgctctgcttcctaagggacgtatctgttgctgcgtctgaacccacggtttatcgaaatcccaccaagatgtcctgccagcagaaccaacagcagtgccagccccctcccaagtgtcctatccccaagtatcccccaaaatgtccctcaaagtgtgcatcctcatgcccacctccaatctcttcctgctgtggctccagctctgggggctgtggttgctgcagctctgagggaggtggctgctgcctgagccaccacagacaccataggtcccactgccacagacccaagagctccaattgctatggcagtggcagtggccagcagtctgggggttctggctgctgctctggagggggctgttgctgacctggaccaggagcagcaccaaaggaattagtgggcgaaggacccattgcagcctggtgttttacctccttcactctcttgcctttcctttctgtagccccatcaattgaataaac

SEQ ID NO: 147513 - DNA, 819 bp, Homo sapiens
  Payload ID: 9190
  Gene Symbol: LCE5A
  Gene Name: late cornified envelope 5A
  Uniprot ID: Q5TCM9
  ENST ID: ENST00000334269
  CDS Start-End: 177-533
caggtagagtgcttctcaggaccaggatgaactcttggtgctggtgttttgggcagaaagagcccctgggtggaggttgaggccattcttgaagaaagacaaggataaagaaggattttggaggggaaggttcttctggaaggggagggtggaagctttattcagcttctacagagatgtcctgccagcagagccagcagcagtgccagcctcctcccaaatgtacccctaaatgccctcccaagtgtactcctaagtgtcctcccaagtgtcccccaaaatgccctccccagtgttcagccccatgcccacctccagtctcttcctgctgtggttccagctctgggggctgctgcagctctgagggtggtggctgctgcctgagccaccacaggccccgccagtccctccgacgccgacctcagagttccagctgctgtggcagtggcagtggccagcagtctgggggctccagctgctgccacagctctgggggctctggctgctgccacagctctggaggctgctgctgacctgggccatgaggagcacggaggagaaggactggcagatcccaggtgctgaagatgtgtgtcagcctgaggcttcttttctctcatttcccatggaaggacttcggaaatgccttaagttcccctctttatcctgcccatgttcactccattgtagggttgaagtctagcttgtgatattttctggcctggctttccctctcagacatagctctttggagaactaggtgttgtaattcagttatgaagctattttctctgtaacaataaagctttttattcctga

SEQ ID NO: 147514 - DNA, 628 bp, Homo sapiens
  Payload ID: 9191
  Gene Symbol: LCE6A
  Gene Name: late cornified envelope 6A
  Uniprot ID: A0A183
  ENST ID: ENST00000431011
  CDS Start-End: 166-408
gactcctcctgggataacttgtccacacatcttccactagggtaaggctacttctggctgaggagacacttggatgtagctcaagtgctgcttaggcagtcctgatctctcctctcgtctcttcccagggagctgaaaagccagattcgacctggtagccaagcaatgtcacagcagaagcagcaatcttggaagcctccaaatgttcccaaatgctcccctccccaaagatcaaacccctgcctagctccctactcgactccttgtggtgctccccattcagaaggttgtcattccagttcccaaaggcctgaggttcagaagcctaggagggctcgtcaaaagctgcgctgcctaagtaggggcacaacctaccactgcaaagaggaagagtgtgaaggcgactgagcccagaagagttgaggcacaggtgcagttactctctccctgccccacctttgggtactaattcccccttggaaagccaggccctcaacctctcatttggactgagaaacacttcctgatccccagctctagagaagcgagaactaggctgagccacgctgctactgctctcttccattcaccccttcagctcagcaacaataaagctgctttacttgga

SEQ ID NO: 147515 - DNA, 523 bp, Homo sapiens
  Payload ID: 9192
  Gene Symbol: LELP1
  Gene Name: late cornified envelope-like proline-rich 1
  Uniprot ID: Q5T871
  ENST ID: ENST00000368747
  CDS Start-End: 111-407
ggaaccaaagggaaaagccaccttcccaggcacagccataacatccacctcactcaactgcttgtcaagttcaccaccaacacagagggggctcagataatcaagaaacaatgtcgagtgatgataaaagtaaatcaaatgaccccaagactgagcccaagaactgcgatcccaagtgtgaacaaaagtgtgagtccaaatgccagcccagctgtttaaagaagctgctgcaacgctgtttcgaaaagtgcccatgggaaaagtgtccagcaccacccaagtgcctgccctgcccctcgcagtctccttcatcctgccctccccagccctgcaccaagccctgtcctcctaaatgcccttcatcctgcccacatgcttgcccacctccctgccctcccccagagtgaggcactgtgggcactacccaaccccaccaccactgccacctccaccatgtacaacgctgtggggctggagactgaaaccatgaactgacaagtaaacgtgttcctctgctgtgcaa

SEQ ID NO: 147516 - DNA, 1179 bp, Homo sapiens
  Payload ID: 9193
  Gene Symbol: LAMTOR1
  Gene Name: late endosomal/lysosomal adaptor, MAPK and MTOR activator 1
  Uniprot ID: Q6IAA8
  ENST ID: ENST00000278671
  CDS Start-End: 164-649
ggggtattgactgaggcggccaagcggctccgggacagggggtacggggggtgggggcgggtggttgcctgcgggaggccgccgcgggtcatgtgaccggaagggctcctcacggacgccgtccctcctcggcgcggcctgagcgcccggcccgaccccggccatggggtgctgctacagcagcgagaacgaggactcggaccaggaccgagaggagcggaagctgctgctggaccctagcagcccccctaccaaagctctcaatggagccgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacagcacccgcttggctgtgctgagcagcagcctgacccattggaagaagctgccaccgctgccgtctcttaccagccagccccaccaagtgctggccagtgagcccatcccgttctctgatttgcagcaggtctccaggatagctgcttatgcctacagtgcactttctcagatccgtgtggacgcaaaagaggagctggttgtacagtttgggatcccatgaagagaggggtccttggacagctcttctcctctcttcatcccatctctaccccacccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcatcca

SEQ ID NO: 147517 - DNA, 849 bp, Homo sapiens
  Payload ID: 9193
  Gene Symbol: LAMTOR1
  Gene Name: late endosomal/lysosomal adaptor, MAPK and MTOR activator 1
  ENST ID: ENST00000544594
  CDS Start-End: 1-239
aggaccgagaggagcggaagctgctgctggaccctagcagcccccctaccaaagctctcaatggagccgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacaggtctccaggatagctgcttatgcctacagtgcactttctcagatccgtgtggacgcaaaagaggagctggttgtacagtttgggatcccatgaagagaggggtccttggacagctcttctcctctcttcatcccatctctaccccacccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcatcca

SEQ ID NO: 147518 - DNA, 1346 bp, Homo sapiens
  Payload ID: 9193
  Gene Symbol: LAMTOR1
  Gene Name: late endosomal/lysosomal adaptor, MAPK and MTOR activator 1
  ENST ID: ENST00000538404
  CDS Start-End: 13-495
ccgaccccggccatggggtgctgctacagcagcgagaacgaggactcggaccaggaccgagaggagcggaagctgctgctggaccctagcagcccccctaccaaagctctcaatggagccgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacagcacccgcttggctgtgctgagcagcagcctgacccattggaagaagctgccaccgctgccgtctcttaccagccagccccaccaagtgctggccagtgagcccatcccgttctctgatttgcagcaggtgagacacccctcacctgcccctgcccacccttctcacactgcccagggtatggcagagggttcacccactctgcctcagaggaggtagggaaggtggagttagggagcctggtagccttgtaggccccagctccctcccacctcgttctcttaactttttatgtctttcctatctccttcctgcaacctttattgtttcactcccctttgttcttttccttctgtctctcccatccctgtctttctctttgccttcctgttccccttcattccctccttctccatcaccatctaatctcccctccccatttttcctgattgccctcctcacctgtctctgttcctctcctccccggcccctctctgtctcaggtctccaggatagctgcttatgcctacagtgcactttctcagatccgtgtggacgcaaaagaggagctggttgtacagtttgggatcccatgaagagaggggtccttggacagctcttctcctctcttcatcccatctctaccccacccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatg

SEQ ID NO: 147519 - DNA, 899 bp, Homo sapiens
  Payload ID: 9193
  Gene Symbol: LAMTOR1
  Gene Name: late endosomal/lysosomal adaptor, MAPK and MTOR activator 1
  ENST ID: ENST00000535872
  CDS Start-End: 74-304
atgtgaccggaagggctcctcacggacgccgtccctcctcggcgcggcctgagcgcccggcccgaccccggccatgggctgctgctggaccctagcagcccccctaccaaagctctcaatggagccgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacagcacccgcttggctgtgctgagcagcagcctgacccattggaagaagctgccaccgctgccgtctcttaccagccagccccaccaagtgctggccagtgagcccatcccgttctctgatttgcagcaggtctccaggatagctgcttatgcctacagtgcactttctcagatccgtgtggacgcaaaagaggagctggttgtacagtttgggatcccatgaagagaggggtccttggacagctcttctcctctcttcatcccatctctaccccacccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcacta

SEQ ID NO: 147520 - DNA, 965 bp, Homo sapiens
  Payload ID: 9193
  Gene Symbol: LAMTOR1
  Gene Name: late endosomal/lysosomal adaptor, MAPK and MTOR activator 1
  ENST ID: ENST00000545249
  CDS Start-End: 23-451
agcgcccggcccgaccccggccatggggtgctgctacagcagcgagaacgaggactcggaccaggaccgagaggagcggaagctgctgctggaccctagcagcccccctaccaaagctctcaatggagccgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacagcacccgcttggctgtgctgagcagcagcctgacccattggaagaagctgccaccgctgccgtctcttaccagccagccccaccaagtgctggccagtgagcccatcccgttctctgatttgcagcaggttcagctgtttcagtccacaccttgttcacagtaagatattcaattcaattcagcaaacatttgttgagtgcttgctgctctgtgcctgaccagaagaaatgaagccaagatacaaataatagaaccctgtcatgagcacagaaagacctgctgagtttctattgattgtggtaaaccagcctgcatccagttccaagtaacagctgcccacttagtgaatactctctcatgtttcaacactcagttctagtgtagcctcttctataaagcctttcttttccagataaaattggttaatgtgtcctgtgttaggctgattgttttgatgatccctattcatggtctcccctgtatccatctctttttgcctataacattgtagtcccatctcactctgatgctgggaccagacatgtgacttgttttagccaatgagatgtcgataaacatgaagcaaacagaagctttaaaggaggcctgccctcttgctctttgccagtgccatgagaacatggctgatcagctggagggttatgagatgtgtaggt

SEQ ID NO: 147521 - DNA, 619 bp, Homo sapiens
  Payload ID: 9193
  Gene Symbol: LAMTOR1
  Gene Name: late endosomal/lysosomal adaptor, MAPK and MTOR activator 1
  ENST ID: ENST00000535107
  CDS Start-End: 14-313
cccgaccccggccatggggtgctgctacagcagcgagaacgaggactcggaccaggaccgagaggagcggaagctgctgctggaccctagcagcccccctaccaaagctctcaatggagccgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacagacatacagggcatcacactgaaaaggagctgtgatctgagggtcaggagtgtgggcctgggtaccagcactgccactgacttgcctctctcagccttagttgccccttcactgaagacctttccagctttggtgatctacgattctatcacagcaagcaacaggaagacagagcatcatgctaggcacataagaagcttttaaaatactggttaaattgagatcaccacaccaggggaatagtgtccaagtcatgctccagctcctttcccctcttagggatcttggactagaaaaggccaaactttatttcttaaaacttgaatctgagttcacagaaa

SEQ ID NO: 147522 - DNA, 587 bp, Homo sapiens
  Payload ID: 9194
  Gene Symbol: LAMTOR2
  Gene Name: late endosomal/lysosomal adaptor, MAPK and MTOR activator 2
  Uniprot ID: Q9Y2Q5
  ENST ID: ENST00000368302
  CDS Start-End: 41-493
gagatctgggtgcaaaagcccagggttaggaaccgtaggcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggagggccgtgtagccatcacccgagtggccaaccttctgctgtgtatgtatgccaaggagaccgtgggctttggaatgctcaaggccaaggctgtgtgcgggactgatctctgttctccctctgcaggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctg

SEQ ID NO: 147523 - DNA, 521 bp, Homo sapiens
  Payload ID: 9194
  Gene Symbol: LAMTOR2
  Gene Name: late endosomal/lysosomal adaptor, MAPK and MTOR activator 2
  Uniprot ID: Q9Y2Q5
  ENST ID: ENST00000368304
  CDS Start-End: 99-386
ggagcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtca

SEQ ID NO: 147524 - DNA, 655 bp, Homo sapiens
  Payload ID: 9194
  Gene Symbol: LAMTOR2
  Gene Name: late endosomal/lysosomal adaptor, MAPK and MTOR activator 2
  Uniprot ID: Q9Y2Q5
  ENST ID: ENST00000368305
  CDS Start-End: 139-516
caatagccaggcgaagaaactacaactcccagggcgtcccggagcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggagggccgtgtagccatcacccgagtggccaaccttctgctgtgtatgtatgccaaggagaccgtgggctttggaatgctcaaggccaaggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtcatgtg

SEQ ID NO: 147525 - DNA, 1220 bp, Homo sapiens
  Payload ID: 9195
  Gene Symbol: LAMTOR3
  Gene Name: late endosomal/lysosomal adaptor, MAPK and MTOR activator 3
  Uniprot ID: Q9UHA4
  ENST ID: ENST00000226522
  CDS Start-End: 80-433
tgaagtgacagcggagagaaccaggcagcccagaaaccccaggcgtggagattgatcctgcgagagaagggggttcatcatggcggatgacctaaagcgattcttgtataaaaagttaccaagtgttgaagggctccatgccattgttgtgtcagatagagatggagtacctgttattaaagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaagttgtggaagtttcttaatctgacagtggtttcagtgtgtaccttatcttcattataacaacacaatatcaatccagcaatctttagactacaataatacttttatccatgtgctcaagaaagggcccctttttccaacttatactaaagagctagcatatagatgtaatttatagatagatcagttgctatattttctggtgtagggtctttcttatttagtgagatctagggataccacagaaatggttcagtctatcacagctcccatggagttagtctggtcaccagatatggatgagagattctattcagtggatcagaatcaaactggtacattgatccacttgagccgttaagtgctgccaattgtacaatatgcccaggcttgcagaataaagccaactttttattgtgaataataataaggacatatttttcttcagattatgttttatttctttgcattgagtgaggaacataaaatggcttggtaaaagtaataaaatcagtacaatcactaactttcctttgtacatattattttgcagtatagatgaatattactaatcagtttgattattctcagagggtgctgctctttaatgaaaatgaaaattatagctaatgttttttcctcaaactctgctttctgtaaccaatcagtgttttaatgtttgtgtgttcttcataaaatttaaatacaattcgttattctgtttccaatgttagtatgtatgtaaacatgatagtacagccatttttttcatatgtgagtaaaaataaaatagtatttttaaaaata

SEQ ID NO: 147526 - DNA, 4226 bp, Homo sapiens
  Payload ID: 9195
  Gene Symbol: LAMTOR3
  Gene Name: late endosomal/lysosomal adaptor, MAPK and MTOR activator 3
  Uniprot ID: Q9UHA4
  ENST ID: ENST00000499666
  CDS Start-End: 194-568
ggaaatcccgtatcgtagggcgacggcggcttagaaagtgcttcctggagcgcagacgaggtcatgaatcatgtgacggtggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgccaatacaggactaattgtcagcctagaaaaggaacttgctccattgtttgaagaactgagacaagttgtggaagtttcttaatctgacagtggtttcagtgtgtaccttatcttcattataacaacacaatatcaatccagcaatctttagactacaataatacttttatccatgtgctcaagaaagggcccctttttccaacttatactaaagagctagcatatagatgtaatttatagatagatcagttgctatattttctggtgtagggtctttcttatttagtgagatctagggataccacagaaatggttcagtctatcacagctcccatggagttagtctggtcaccagatatggatgagagattctattcagtggatcagaatcaaactggtacattgatccacttgagccgttaagtgctgccaattgtacaatatgcccaggcttgcagaataaagccaactttttattgtgaataataataaggacatatttttcttcagattatgttttatttctttgcattgagtgaggaacataaaatggcttggtaaaagtaataaaatcagtacaatcactaactttcctttgtacatattattttgcagtatagatgaatattactaatcagtttgattattctcagagggtgctgctctttaatgaaaatgaaaattatagctaatgttttttcctcaaactctgctttctgtaaccaatcagtgttttaatgtttgtgtgttcttcataaaatttaaatacaattcgttattctgtttccaatgttagtatgtatgtaaacatgatagtacagccatttttttcatatgtgagtaaaaataaaatagtatttttaaaaatatagtttgagcactgtataggtcctttttttgttcagactttttccaaaaatctaaacataattaatatactctttcagccacatgaataaataatgagtgtttcttgtaggtattggtttggagattgttttacggtagtatgaactgttaactggaaaagaaacctgagattgcagtcagccaagattgtgccactgcaccccagcctgggcaacagagactccgtctcaaaaacaaaaaagaaaagaaaccaagaaacctcaggcatgaacctaatttaatctccatgaaagaggtactacagttctagaatataccctttatgttcaggaatgcagtctatcattcagagttaatttctttctaggctctttgacaatcagtttttccctggatcagttcagtacatatgcattgagcacctgtgtgccagtcagccgagctatcacattgcacaattctaagaagcaccattcatgtctcatcatatttctatgctctgggagttgcctttcacatagaatatgtgtgattgttatccctagaattgtgcagtgaggcaattggctaggtgctgtgctgctttttctttctttctttttttttttaagagacagagtcttgctgtgttgcccagtctggagtgcagtggtggcatgatcttgcctcactgtaacctctgcctcctgggttcaagctgttctcatgccccattctcccttgtagctgggattacaggcttacaccatcgcacttggcaaatttgtgtatttttagtagagacaggaattcaccatgttggccaggctggtcttgaactcctgacttaaagtgatccacctgctttggcctcccaaaatgctaggattataggtgtgagccactgcaccgggccatgtgctactttttcttccttccatccttcctcccttcttcagtgtaaatatgagattaatttgtgataccttactttaaagaacttagagttcagtaaaggaagcaggtatagaaagtgctatgataaagctatacataggatggtatagaaccacagactaggggcacttaaaatgggcaagaaaatagcctttgtaaataaaatagaggcaagagatataatgctttacctgcaaagagctataaatacagccatgtaccatataatgatgtttcagttagtgaaggaccacatacgagggtggtcagaacagcaggctataccatatagcctaggtgtgtagtaggctataccatatagcctaggtgtgtagtagtaggctataccatatagcctaggtgtgtagtagtaggcgataccatatagcctaggtgtgtagtagtaggctataccatatagcctaggtgtatagtagtaggctataccatatagcctaggtgtgtagtaggctataccatatagcctaggtatgtagtagtaggctataccatatagcctaggtgtgtagtagtaggctataccatctggggttcctgtcagtacagtatgatgttcacataatgatgaaatcacctaacaaagcatgtctcgaaatgtatccacattgttacgtaacacatgactgtagttaattgttacaattgaaatactagatgtactcattgaaatccagaattcccattatctggattatttaatatcgttcaggaaatttttgccagtgcaatggtgcatgaaacaatgtcttttagaaatgaggtggccagatttctatttgcagataataattgtatatctaaaaatcctagaaaaagaaatgataacaaatggagctacttaacctttacatgttgaatgctgccactgttaaaatttctgagggggtataatagataaactatcccatagttcatctggaaaaataaggtggtgaaaattgctaagaaatttttgaaagggtaatgtaaacctagattaactgtttttgaaaggtagtacagaactgaatgcacaactagatatcaatggtatgtactcacccagaaaaaagacttcagtacatacatgtgagggcttaaaacattgttataaagacgggatcacaatgggaaaaggattattcaataagtagggcaggcattctctatgcctgctagggaagtgtgacttgttatactctttatgtacagcaattggcagtctgtgaaacttttaaattcatatacataaccttttgccctgcaattccacttctagaaatttatcctaccaaacaaagcacatagatgtgcaaaagtatgtatttacaagtatattctttgcaacttggtaatgtcaaagaattggaagcaacctaaatatctgccataggtaggataaccatatgctttggctttttgaacactaccagtttatacctgctgttcttggataattattaatagtgctttcattctcaatgtctcactttagataataaattacagaggattggtgaaactaatttgcccaatggaaaaaggaatgaagaagtgctttaggtactgagatgaaaagatctctaaggcataataatgtttattgagaaaagcatggtgtcaaactgtatggcatgctacaattgatgtataagaagaaaaaatgtgtatgtattcctatttgtttgtatatggtagactgtctctgaagacatatatggaagaacctgatcacattggtagtctccaaggagcagaactagatacctgggggataaggatcccaggagtgagccttttcattgtaaacttcattgtactttgagtttttaactgttcaaaaataataaaattagaaataaaatatttcaacaaacaataaaatgggatatttggggaagaaagttgtctcagggctctccaaagaagcagaa

SEQ ID NO: 147527 - DNA, 605 bp, Homo sapiens
  Payload ID: 9196
  Gene Symbol: LAMTOR4
  Gene Name: late endosomal/lysosomal adaptor, MAPK and MTOR activator 4
  Uniprot ID: Q0VGL1
  ENST ID: ENST00000341942
  CDS Start-End: 67-366
gtgaccggggcctgaagccggaagctacctatctggtagggagctcccccagcaccgaagactgcgatgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctcca

SEQ ID NO: 147528 - DNA, 730 bp, Homo sapiens
  Payload ID: 9196
  Gene Symbol: LAMTOR4
  Gene Name: late endosomal/lysosomal adaptor, MAPK and MTOR activator 4
  ENST ID: ENST00000441173
  CDS Start-End: 36-449
tctggtagggagctcccccagcaccgaagactgcgatgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctggtgagcccctgcccctgcccttggtggtggtactgggagcggggggctacttccaggggcttctcggcttctcttcttccagcctcctaccatctcctggggtctctggtctggccactttcctccctttgggactccctggtatcagaattgtgaatgagaaggcaagagaaaggagatctagcagaggccactcatcttcaaatctctgagcctggaactatagaacttctttggctttgatcccagccaatgtgcgtgtggccccgccccatggagtctgttgcacccactaactctgtgctcccttccctctcctggggcgggggaaggtgtgtctctcctccagtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcc

SEQ ID NO: 147529 - DNA, 519 bp, Homo sapiens
  Payload ID: 9196
  Gene Symbol: LAMTOR4
  Gene Name: late endosomal/lysosomal adaptor, MAPK and MTOR activator 4
  ENST ID: ENST00000474141
  CDS Start-End: 62-280
cggggcctgaagccggaagctacctatctggtagggagctcccccagcaccgaagactgcgatgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctcca

SEQ ID NO: 147530 - DNA, 621 bp, Homo sapiens
  Payload ID: 9196
  Gene Symbol: LAMTOR4
  Gene Name: late endosomal/lysosomal adaptor, MAPK and MTOR activator 4
  ENST ID: ENST00000468582
  CDS Start-End: 248-373
gagtgaggacgcatgcgcgagaggacccgccgggggttcagcgtctctgctccccagtctgtgtggtttccccctgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctccagcccaggga

SEQ ID NO: 147531 - DNA, 616 bp, Homo sapiens
  Payload ID: 9196
  Gene Symbol: LAMTOR4
  Gene Name: late endosomal/lysosomal adaptor, MAPK and MTOR activator 4
  ENST ID: ENST00000460732
  CDS Start-End: 61-309
ggggcctgaagccggaagctacctatctggtagggagctcccccagcaccgaagactgcgatgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctggtgtgtctctcctccagtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctcca

SEQ ID NO: 147532 - DNA, 613 bp, Homo sapiens
  Payload ID: 9196
  Gene Symbol: LAMTOR4
  Gene Name: late endosomal/lysosomal adaptor, MAPK and MTOR activator 4
  ENST ID: ENST00000488241
  CDS Start-End: 232-306
gcgagaggacccgccgggggttcagcgtctctgctccccagtctgtgtggtttccccctgacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctggtgtgtctctcctccagtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctcca

SEQ ID NO: 147533 - DNA, 720 bp, Homo sapiens
  Payload ID: 9196
  Gene Symbol: LAMTOR4
  Gene Name: late endosomal/lysosomal adaptor, MAPK and MTOR activator 4
  ENST ID: ENST00000473459
  CDS Start-End: 356-481
gagggggccgggaagggacctggctggggaatgagaaaacctggggccatcgtcaacccagagacttgggtttgcaggtgaagggtatcgggccgtccatccctctagcatgcttctcacgacttgcatctttacccactagacttctgcgctgacccaggggctggagcgaatcccagaccagctcggctacctggtactgagtgaaggtgcagtgctggcgggcagcaagtgtgaagacagaaaaagatggagccattaacagtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggcagaaccgaggtcgggagcccattgatgtctgagcctgccggagggcgagggtcggagaagcggattgggtcctgggcctctgtgatgaggcaggcacacctgtcggtcttggcttgctgctagaactagggccttctgctcgcccacctcccacccctacctggacgggcccaggcttggggactctgagctgtgttaaggagaacaagggcaaggagacctccctttgtgctccctcactccctaataaacatgagtctgatgttctcca

SEQ ID NO: 147534 - DNA, 371 bp, Homo sapiens
  Payload ID: 9196
  Gene Symbol: LAMTOR4
  Gene Name: late endosomal/lysosomal adaptor, MAPK and MTOR activator 4
  ENST ID: ENST00000466498
  CDS Start-End: 312-371
gggggccgggaagggacctggctggggaatgagaaaacctggggccatcgtcaacccagagacttgggtttgcaggtgaagggtatcgggccgtccatccctctagcatgcttctcacgacttgcatctttacccactagacttctgcgctgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacg

SEQ ID NO: 147535 - DNA, 401 bp, Homo sapiens
  Payload ID: 9196
  Gene Symbol: LAMTOR4
  Gene Name: late endosomal/lysosomal adaptor, MAPK and MTOR activator 4
  ENST ID: ENST00000490633
  CDS Start-End: 1-58
cggcatgaatgtgcccttcaagcgcctgtctgctttttatttcatccccaaaatctaagggtcctgcctccgtccaccccagcattctgcatcactcagcactcagcccagaccctccccagcccacctcgaagagccccgtcctcagagcctggaaggccacactgaaggtgagcgcgctgcccttccgggaaaagccaaggttgttgaggggcgtgtggcagacgacggagtccagggcagcctgcatggcccggcgctcctcctcacacagctgctttcctgggggcagaaacagggaccagcaaacactacagcgttcctcattcccacagggccttcgccagcacagtctcatctgattctcaaagccactctgtggagtaaactgagcaaacgtt

SEQ ID NO: 147536 - DNA, 868 bp, Homo sapiens
  Payload ID: 9197
  Gene Symbol: LAMTOR5
  Gene Name: late endosomal/lysosomal adaptor, MAPK and MTOR activator 5
  ENST ID: ENST00000256644
  CDS Start-End: 77-598
gccacgaactgaagcactgaggcccggctgcagacctctcccgagaggggaataatccgtgccggccggttccgccatggagccaggtgcaggtcacctcgacggtcaccgcgcggggagcccaagccttcgtcaggctctgtgcgacggaagcgcagtgatgttttccagtaaagaacgcggacgttgcaccgtgatcaattttgtccctttggaggcgccgttacggtccacgccccgctcgcgtcaagtgactgaggcctgtggtggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaaaa

SEQ ID NO: 147537 - DNA, 1154 bp, Homo sapiens
  Payload ID: 9197
  Gene Symbol: LAMTOR5
  Gene Name: late endosomal/lysosomal adaptor, MAPK and MTOR activator 5
  ENST ID: ENST00000474861
  CDS Start-End: 608-880
gaaggacgtgccgtgccgctgggttctgagccggagtggtcggtgggtgggatggaggcgaccttggagcagcacttggaagacacgtgagtagtgcgcgcctcttcggcctgtcctgaggtcgcggcggaggaacttgagcggaacgaaaggcgcgagctgcgagtaccggccagggcgtctcggggacgtcgcgcgacccccgggacacgggatgagggggctaaactctacccaaggccgcagggcggggcgggtgacccggaattaaaatcctgccgggcaccgcacattccctcttgagcgagtctcccgggcccaggccacgggccaaaactgcctatctcgttgttgaaatcgtctttacggtcagggtggttctgcggaagttttagaaaacgggttgacttttgggaagattgtgccagttgtgcagtgtcgagccctgcagtgtaaacaaacacgtatctcctgtgtgtaacctatcagttacttggtgcttaagtagataaaaatcattctttaaatttttcgaacaagcagtatctatgtaaaattcaaaactggaaaagtgtaaagggtacagagagacacctgcctcccaccgatgtccctcagcttccacttaccctccaggagaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaaaatgga

SEQ ID NO: 147538 - DNA, 694 bp, Homo sapiens
  Payload ID: 9197
  Gene Symbol: LAMTOR5
  Gene Name: late endosomal/lysosomal adaptor, MAPK and MTOR activator 5
  ENST ID: ENST00000483260
  CDS Start-End: 148-420
ggacgtgccgtgccgctgggttctgagccggagtggtcggtgggtgggatggaggcgaccttggagcagcacttggaagacactatctatgtaaaattcaaaactggaaaagtgtaaagggtacagagagacacctgcctcccaccgatgtccctcagcttccacttaccctccaggagaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaaaatgga

SEQ ID NO: 147539 - DNA, 553 bp, Homo sapiens
  Payload ID: 9197
  Gene Symbol: LAMTOR5
  Gene Name: late endosomal/lysosomal adaptor, MAPK and MTOR activator 5
  ENST ID: ENST00000602858
  CDS Start-End: 48-287
ttttctcccattatgtacttcaactctcttgtgttcctggaattagaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggagg

SEQ ID NO: 147540 - DNA, 634 bp, Homo sapiens
  Payload ID: 9197
  Gene Symbol: LAMTOR5
  Gene Name: late endosomal/lysosomal adaptor, MAPK and MTOR activator 5
  Uniprot ID: O43504
  ENST ID: ENST00000602318
  CDS Start-End: 89-364
gccccgctcgcgtcaagtgactgaggcctgtggtggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggaggaaaa

SEQ ID NO: 147541 - DNA, 846 bp, Homo sapiens
  Payload ID: 9197
  Gene Symbol: LAMTOR5
  Gene Name: late endosomal/lysosomal adaptor, MAPK and MTOR activator 5
  ENST ID: ENST00000614544
  CDS Start-End: 59-580
gaggcccggctgcagacctctcccgagaggggaataatccgtgccggccggttccgccatggagccaggtgcaggtcacctcgacggtcaccgcgcggggagcccaagccttcgtcaggctctgtgcgacggaagcgcagtgatgttttccagtaaagaacgcggacgttgcaccgtgatcaattttgtccctttggaggcgccgttacggtccacgccccgctcgcgtcaagtgactgaggcctgtggtggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggagg

SEQ ID NO: 147542 - DNA, 5087 bp, Homo sapiens
  Payload ID: 9198
  Gene Symbol: LTBP1
  Gene Name: latent transforming growth factor beta binding protein 1
  Uniprot ID: Q14766
  ENST ID: ENST00000407925
  CDS Start-End: 82-4269
cgggttgtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccactattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgtgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggaattgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaa

SEQ ID NO: 147543 - DNA, 4948 bp, Homo sapiens
  Payload ID: 9198
  Gene Symbol: LTBP1
  Gene Name: latent transforming growth factor beta binding protein 1
  ENST ID: ENST00000402934
  CDS Start-End: 114-4136
cactgaaggcttccctctttccttaaacctgtcgggttgtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccactattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatgtagatgtagatcaacccaaagaagaaaagaaagaatgctactataatctcaatgacgccagtctctgtgataatgtgttggcccccaatgtcacgaaacaagaatgctgctgtacatcaggcgtgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggaattgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtag

SEQ ID NO: 147544 - DNA, 5092 bp, Homo sapiens
  Payload ID: 9198
  Gene Symbol: LTBP1
  Gene Name: latent transforming growth factor beta binding protein 1
  Uniprot ID: Q14766
  ENST ID: ENST00000404525
  CDS Start-End: 100-4128
ctctttccttaaacctgtcgggttgtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccactattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgtgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggaattgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggctaaa

SEQ ID NO: 147545 - DNA, 6333 bp, Homo sapiens
  Payload ID: 9198
  Gene Symbol: LTBP1
  Gene Name: latent transforming growth factor beta binding protein 1
  Uniprot ID: Q14766
  ENST ID: ENST00000404816
  CDS Start-End: 354-5519
cgctcgctctcggccaccctcgccgggccccgctgcggcgcgcgctgcaacccccggccggacgcgcggaccctcaccttgcgcggcccgctcccctcgcccctccccgctccccgggctccgcgctccccacccccacgccctcctcctgctcccagccacaatcggccggggtctggggccgctcagctgcccgcagagcctcctccctcgccaccgacttggtctcctcccgcctttcccgggctctcggcagctctcgggggagcccgaacgcgcggggaaaggcgagccgcacggccgggggagggggccggaccgcgcgcgaccggtcgcgcccgctggggcccgcgatggcgggggcctggctcaggtgggggctcctgctctgggcagggctcctcgcgtcctcggcgcacggccggctgcggaggatcacctacgtggtgcacccgggccccggcctggcagccggcgccttgcccctgagcgggcccccgcgttcgcggacattcaacgtcgcgctcaacgccaggtacagccgcagctcggcggctgccggcgcccccagccgtgcctcccccggggtcccctcggagaggacccggcgcacgagcaagccgggcggcgcggccctgcaggggctcagaccgccgccgccgccgccgccggagcctgcgcgtcccgcggtccccggcgggcagctccaccccaatcccggcggccacccggcagccgccccgttcaccaaacaaggcaggcaagttgtgcgctccaaggtgccgcaggagacccagagcggcggaggctctaggctgcaggttcaccagaagcagcagctgcagggggtcaatgtctgtggagggcggtgctgtcatggctggagtaaggcccctggctcccagaggtgcaccaaacctagctgtgttccgccatgtcagaatggagggatgtgtctccggccacaactctgtgtgtgtaaaccagggaccaagggcaaagcctgtgaaacaatagctgcccaggacacctcgtcaccagtctttggagggcagagtcctggggctgcttcctcgtggggccctcctgagcaagcagcaaagcatacttcatctaagaaggcagacactctaccaagagtcagccctgtggcccagatgaccttaaccctcaagccgaagccttcagtgggactcccccagcagatacattctcaagtgactcctctttcttcccagagtgtggtgattcaccatggccagacccaggaatacgtgctcaagcccaagtactttccagcccagaaggggatttcaggagagcagtccactgaaggttctttccctttaagatatgtgcaggatcaagttgcggcaccttttcagctgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccactattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgtgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggaattgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaa

SEQ ID NO: 147546 - DNA, 799 bp, Homo sapiens
  Payload ID: 9198
  Gene Symbol: LTBP1
  Gene Name: latent transforming growth factor beta binding protein 1
  ENST ID: ENST00000415140
  CDS Start-End: 1-799
gaggccgttgtgaggatattgatgaatgtttgaatccaagcacttgtccagatgagcagtgtgtgaattctcctggatcttaccagtgcgttccctgcacagaaggattccgaggctggaatggacagtgccttgatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagc

SEQ ID NO: 147547 - DNA, 5164 bp, Homo sapiens
  Payload ID: 9198
  Gene Symbol: LTBP1
  Gene Name: latent transforming growth factor beta binding protein 1
  ENST ID: ENST00000418533
  CDS Start-End: 142-4203
gagacaccactgaatacagagcagcgagcactgaaggcttccctctttccttaaacctgtcgggttgtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccactattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgtgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggaattgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggct

SEQ ID NO: 147548 - DNA, 810 bp, Homo sapiens
  Payload ID: 9198
  Gene Symbol: LTBP1
  Gene Name: latent transforming growth factor beta binding protein 1
  ENST ID: ENST00000422669
  CDS Start-End: 1-810
gaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgtgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaa

SEQ ID NO: 147549 - DNA, 593 bp, Homo sapiens
  Payload ID: 9198
  Gene Symbol: LTBP1
  Gene Name: latent transforming growth factor beta binding protein 1
  ENST ID: ENST00000432635
  CDS Start-End: 289-593
aacccctttgcattacatctgcctgtcagggttggctctttaatctgtcgtgccctcggtattgctctttgtctgcccgtgaataaagtgcagcattgtgtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggcca

SEQ ID NO: 147550 - DNA, 713 bp, Homo sapiens
  Payload ID: 9198
  Gene Symbol: LTBP1
  Gene Name: latent transforming growth factor beta binding protein 1
  ENST ID: ENST00000413303
  CDS Start-End: 57-713
atattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccactattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaac

SEQ ID NO: 147551 - DNA, 662 bp, Homo sapiens
  Payload ID: 9198
  Gene Symbol: LTBP1
  Gene Name: latent transforming growth factor beta binding protein 1
  ENST ID: ENST00000468091
  CDS Start-End: 1-662
agttctggaagacagtgtatgcaccctctgtctgttcacctcaccaagcagctctgctgttgtagtgtgggcaaggcctggggcccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaagtggcaactgcaccccctgaaaaggaaataccttcattggatcaagagaaaaccaaacttgagcctggtcaaccccagctgtctccaggcatttccactattcatctgcatccacagtttccaggtatagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgaggg

SEQ ID NO: 147552 - DNA, 8567 bp, Homo sapiens
  Payload ID: 9199
  Gene Symbol: LTBP2
  Gene Name: latent transforming growth factor beta binding protein 2
  Uniprot ID: Q14767
  ENST ID: ENST00000261978
  CDS Start-End: 388-5853
cctcgctccctctccggtaatgagggggctgagctgtccctccgaggagggggcctggtgtggataaaagagacgaaaaagccgggggaggtttccaaaaataaaaccgtccgggtccccttcagacggctgcaggcacagggaggaggcgcgaaggtgcagcagccgtgcgagcccagctggagtaggagcgcggactcgaggctcggggcgcgcagccctcgttccgccgagagccgggcccccagtcggccgcttcagggccccctagactcagagaagctggccgccgggcggggccgggagaacagcccgcgggcgtccagcgtgccgaccacaaagctcttcgcggtgcccgcgcgcaccactctccagccgccccgcgccatgaggccgcggaccaaagcccgcagcccggggcgcgccctgcggaacccctggagaggcttcctgccgctcaccctggctctcttcgtgggcgcgggtcatgcccaaagggaccccgtagggagatacgagccggctggtggagacgcgaatcgactgcggcgccctgggggcagctacccggcagcggctgcagccaaggtgtacagtctgttccgggagcaggacgcgcctgtcgcgggcttgcagcccgtggagcgggcccagccgggctgggggagccccaggaggcccaccgaggcggaggccaggaggccgtcccgcgcgcagcagtcgcggcgtgtccagccacctgcgcagacccggagaagcactcccctgggccagcagcaaccagcaccccggacccgggccgcgccggctctcccacgcctggggaccccacagcggtctggggctgcgcccccaaccccgccgcgagggcggctcacggggaggaacgtctgcgggggacagtgctgcccaggatggacaacagcaaacagcaccaaccactgtatcaaacccgtttgcgagccgccgtgccagaaccggggctcctgcagccgcccgcagctctgtgtctgccgctctggtttccgtggagcccgctgcgaggaggtcattcccgatgaggaatttgacccccagaactccaggctggcacctcgacgctgggccgagcgttcacccaacctgcgcaggagcagtgcggctggagagggcaccttggccagagcacagccgccagcaccacagtcgccgcccgcaccacagtcgccaccagctgggaccctgagtggcctcagccagacccacccttcccagcagcacgtggggttgtcccgcactgtccgacttcacccgactgccacggccagtagccagctctcttccaacgccctgcccccgggaccaggccttgagcagagagatggcacccaacaggcggtacctctggagcacccctcatccccctgggggctgaacctcacggagaaaatcaagaagatcaagatcgtcttcactcccaccatctgcaagcagacctgtgcccgtggacactgtgccaacagctgtgagaggggcgacaccaccaccctgtacagccagggcggccatgggcacgatcccaagtctggcttccgcatctatttctgccagatcccctgcctgaacggaggccgctgcatcggcagggacgaatgctggtgccccgccaactccaccgggaagttctgccacctgcctatcccgcagccggacagggagcctccagggagggggtcccgccccagggccttgctggaagccccactgaagcagtccactttcacactgccgctctccaaccagctggcctccgtgaacccctccctggtgaaggtgcacattcaccacccacccgaggcctcagtgcagatccaccaggtggcccaggtgcggggcggggtggaggaggccctagtggagaacagcgtggagaccagacccccgccctggctgcctgccagccctggccacagcctctgggacagcaacaacatccctgctcggtctggagagccccctcggccactgcccccagcagcacccaggcctcgaggactgctgggccggtgttacctgaacactgtgaacggacagtgtgccaaccctctgctggagctgactacccaggaggactgctgtggcagtgtgggagccttctggggggtgactttgtgtgccccatgcccacccagaccagcctccccggtgattgagaatggccagctggagtgtcctcaggggtacaagagactgaacctcactcactgccaagatatcaacgagtgcttgaccctgggcctgtgcaaggacgcggagtgtgtgaataccaggggcagctacctgtgcacatgcagacctggcctcatgctggatccatcgcggagccgctgtgtgtcggacaaggcaatctccatgctgcagggactgtgctaccggtcgctggggcccggcacctgcaccctgcctttggcccagcggatcaccaagcagatatgctgctgcagccgcgtgggcaaagcatggggcagcgagtgtgagaaatgccctctgcctggcacagaggccttcagagagatctgccctgccggccacggctacacctacgcgagctccgacatccgcctgtccatgaggaaagccgaggaggaggaactggcaaggcccccaagggagcaagggcagaggagcagcggggcactgcccgggccagcagagaggcagcccctccgggtcgtcacggacacctggcttgaggccgggaccatccctgacaagggtgactctcaggctggccaggtcacgaccagtgtcactcatgcacctgcctgggtcacagggaatgccacaaccccaccaatgcctgaacaggggattgcagagatacaggaagaacaagtgaccccctccactgatgtgctggtgaccctgagcaccccaggcattgacagatgcgctgctggagccaccaacgtctgtggccctggaacctgcgtgaacctccccgatggatacagatgtgtctgcagccctggctaccagctgcaccccagccaggcctactgcacagatgacaacgagtgtctgagggacccctgcaagggaaaagggcgctgcatcaaccgcgtggggtcctactcctgcttctgctaccctggctacactctggccacctcaggggcgacacaggagtgtcaagatatcaatgagtgtgagcagccaggggtgtgcagcggggggcagtgcaccaacaccgagggctcgtaccactgcgagtgtgatcagggctacatcatggtcaggaaaggacactgccaagatatcaacgaatgccgtcaccccggtacctgccctgatgggagatgcgtcaattcccctggctcctacacttgtctggcctgtgaggagggctaccggggccagagtgggagctgtgtagatgtgaatgagtgtctgactcccggggtctgtgcccatggaaagtgcaccaacctagaaggctccttcagatgctcttgtgagcagggctatgaggtcacctcagatgagaagggctgccaagatgtggatgagtgtgccagccgggcctcatgccccacaggcctctgcctcaacacggagggctccttcgcctgctctgcctgtgagaacgggtactgggtgaatgaagacggcactgcctgtgaagacctagatgagtgtgccttcccgggagtctgcccctccggagtctgcaccaacacggctggctccttctcctgcaaggactgcgatgggggctaccggcccagccccctgggtgactcctgtgaagatgtggatgaatgtgaagacccccagagcagctgcctgggaggcgagtgcaagaacactgtgggctcctaccagtgcctctgtccccagggcttccagctggccaatggcaccgtgtgtgaggatgtgaatgagtgcatgggggaggagcactgcgcaccccacggcgagtgcctcaacagccacgggtctttcttctgtctgtgcgcgcctggcttcgtcagcgcagaggggggcaccagctgccaggatgtggacgagtgtgccaccacagacccgtgtgtgggagggcactgtgtcaacaccgagggctccttcaactgtctatgtgagactggcttccagccctccccagagagtggagagtgtgtggatattgacgagtgtgaggactatggagacccggtgtgtggcacctggaagtgtgaaaacagccctggctcctaccgctgtgttctgggctgccagcctggcttccacatggccccgaacggagactgcattgacatagacgagtgcgccaacgacaccatgtgtggcagccacggcttctgtgacaacactgatggctccttccgctgcctctgtgaccagggcttcgagatctctccctcaggctgggactgtgtggatgtgaacgagtgtgagcttatgctggcggtatgtggggccgcgctctgtgagaacgtggagggctccttcctgtgcctctgtgccagtgacctggaggagtacgatgcccaggaggggcactgccgcccacggggggctggaggtcagagtatgtctgaggccccaacgggggaccatgccccggcccccacccgcatggactgctactccgggcagaagggccatgcgccctgctccagtgtcctgggccggaacaccacacaggctgaatgctgctgcacccagggcgctagctggggagatgcctgtgacctctgcccgtctgaggactcagctgaattcagcgagatctgccctagtggaaaaggctacattcctgtggaaggagcctggacgtttggacagaccatgtacacagatgcggatgagtgtgtgatattcgggcctggtctctgcccgaacggccggtgcctcaacaccgtgcctggttatgtctgcctgtgcaatcccggcttccactacgatgcttcccacaagaagtgtgaggatcacgatgagtgccaggacctggcctgtgagaatggcgagtgcgtcaacacggagggctccttccactgcttctgcagccccccgctcaccctggacctcagccagcagcgctgcatgaacagcaccagcagcacggaggacctccctgaccacgacatccacatggacatctgctggaaaaaagtcaccaatgatgtgtgcagcgaacccctgcgtgggcaccgcaccacctacacggaatgctgctgccaggacggcgaggcctggagccagcagtgtgctctgtgtcccccgaggagctctgaggtctatgctcagctgtgcaacgtggctcgcattgaggcagagcgggaggccggggtccacttccggccaggctatgagtatggccccgggcccgatgacctgcactacagcatctatggcccagatggggcccccttctacaactacctgggccccgaggacaccgtccctgagcctgccttccccaacacagccggtcactcagcggaccgcacacccatccttgagtctcctttgcagccctcagaactccagccccactacgtggccagccatccagagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctctggctgtaagcttcggtcattgcctccatgcccttgcttggctcaagcaccaccaatcgctttaatgcttcagccaccgcatgaggccctgtccaccacctttcctggccttgctatgggatgcttaccaaaggatggccctcatccaccctcccaagctgtgcgagcatgcaaggccccatggcctcacactgcagacacccctttccagccacaatccaccatcatcctgacgatcccacaactgggacagaggctacatctgccctagggaggtccttcagaatctgtggagcaagaaaggatttggggaagcttggggactgactccagagccccctcctaagaaccatcaccaccactcagccaatctgttctgggccctgattttgccacacctccatcctgtagcccattctctgaccccaaggagtggcagaagatcccttcactcagagaagcaaggctgatattagcttgttgaatgtaagagacacaaatgaagaagaacaaagagcctgagaaagcagcaagaggacatgatgaaaaatacgtggagttgatgagaaaggggagccaaggctttatacgtctaaagaaaatattcagtagctgaatccgcccagtgatagcctgtgggcaccagcagcaagggctgccatgggatacagcacccatctacaaagacctctattacataaacactgcttcttacaggaaacaaacctcttctgggatctccttttgtgaaaaccagtttgatgtgctaaaagtaaaaagtctattttccagtgtggtcttgttcagaagcagccagatttccaatgttgtttttcccctccactcagaaacccctgccctttcccttcagaaaacgatggcaggcattcctctgagtttacaagcagagactcactccaacccaaactagctgggagttcagaaccatggtggaataaagaaatgtgcatctggtctcttctgttgtttttatttcatatcagattaaatttctttaccatgttggctaagtctaaatattagagatgaggctgtgcctactccctggccagctctgctgatagcctatgatgggttccaatgggaaatgactctttactattaaaagacaaggaaagctctgacttcgtacttctctgatgaatggcaatgtaaatgaacaaggctccatgtgactggagcatggaagtgaatgctactttcttaatttaatctgccctgtcctacctgctcctctgattgttagccatcacataacttattgaatgcttgccatgtgccaggcactgtgctgagtgccatacatacatttcatttaattatccaataatcctacttactattgtttattctcaatttacaggtgaggaaactgagacatagaaagcttaaataatttgctctaggtccctatactaattgagatgttttcagcagacaaaaataagtcactcttacgcatgtaaaaatattctttcactcataataaaagaaatgcaacttaaaaccatactgagatcctttttaaaactgtcagattggcaaagatcaaaaagcttgttaagactcctagctggcaagcatgtgggaaataggtactctcataacagctgacagaagtacatattgaagaggacaatatggcaatgtccttcaaaattataaaagcactaactctttgatccagtagtttccacttctaggaacttaaccttcagatatattttcaccagatataaaatgacatacgtaagaagttattactgcatcatttgtaatagctaaagattagaaacaattaattgctatggaacccttaaaaaaggtggctctaaattccttaagaaagatatccaaaacaaattaaggggaaaagggagggttgcataacagcatgtaacataacactatttgtctaaagaatggggaaagagaagcggttgtctgttcacctcatccttgccactccgccttatacctcaccatcggagaacttaccatcccccaaatatatcctgctggcactacaccttcgtaactgctgttcccactgcccccacaacactccaatctccaccttcctgccaaccttgagatattgtatgcatatatacatatttcctttgtttaaaatacaaatagcatactatgcatgctgttctgcactttgctttttttttatacttgcaattagagctgcctcatttcattttacagctgtatactattccattgaatggataaaccataatttatttaatcagtccctcactgacagacgtttccattgtttcctgtcttttgctataaataatgctgtaatgaatattcttgtgcatatttcacattaatttatgggattacatctgcaggataaattcttagaaccaatggtggtttgtggggagggtgacagggtggataggtacaggattgggagacttttcactgtatctccttttgtatttttttgaattttgtaccatatgtatcacctattcaaaaaaaataaaatatttttaaatacagttgctggccaaa

SEQ ID NO: 147553 - DNA, 699 bp, Homo sapiens
  Payload ID: 9199
  Gene Symbol: LTBP2
  Gene Name: latent transforming growth factor beta binding protein 2
  ENST ID: ENST00000556206
  CDS Start-End: 1-699
cacggagggctccttcgcctgctctgcctgtgagaacgggtactgggtgaatgaagacggcactgcctgtgaagacctagatgagtgtgccttcccgggagtctgcccctccggagtctgcaccaacacggctggctccttctcctgcaaggactgcgatgggggctaccggcccagccccctgggtgactcctgtgaagatgtggatgaatgtgaagacccccagagcagctgcctgggaggcgagtgcaagaacactgtgggctcctaccagtgcctctgtccccagggcttccagctggccaatggcaccgtgtgtgaggatgtgaatgagtgcatgggggaggagcactgcgcaccccacggcgagtgcctcaacagccacgggtctttcttctgtctgtgcgcgcctggcttcgtcagcgcagaggggggcaccagctgccaggatattgacgagtgtgaggactatggagacccggtgtgtggcacctggaagtgtgaaaacagccctggctcctaccgctgtgttctgggctgccagcctggcttccacatggccccgaacggagactgcattgacatagacgagtgcgccaacgacaccatgtgtggcagccacggcttctgtgacaacactgatggctccttccgctgcctctgtgaccagggcttcgagatctctccctcaggctggga

SEQ ID NO: 147554 - DNA, 5614 bp, Homo sapiens
  Payload ID: 9199
  Gene Symbol: LTBP2
  Gene Name: latent transforming growth factor beta binding protein 2
  ENST ID: ENST00000556690
  CDS Start-End: 129-5462
agggccccctagactcagagaagctggccgccgggcggggccgggagaacagcccgcgggcgtccagcgtgccgaccacaaagctcttcgcggtgcccgcgcgcaccactctccagccgccccgcgccatgaggccgcggaccaaagcccgcagcccggggcgcgccctgcggaacccctggagaggcttcctgccgctcaccctggctctcttcgtgggcgcgggtcatgcccaaagggaccccgtagggagatacgagccggctggtggagacgcgaatcgactgcggcgccctgggggcagctacccggcagcggctgcagccaaggtgtacagtctgttccgggagcaggacgcgcctgtcgcgggcttgcagcccgtggagcgggcccagccgggctgggggagccccaggaggcccaccgaggcggaggccaggaggccgtcccgcgcgcagcagtcgcggcgtgtccagccacctgcgcagacccggagaagcactcccctgggccagcagcaaccagcaccccggacccgggccgcgccggctctcccacgcctggggaccccacagcggtctggggctgcgcccccaaccccgccgcgagggcggctcacggggaggaacgtctgcgggggacagtgctgcccaggatggacaacagcaaacagcaccaaccactgtatcaaacccgtttgcgagccgccgtgccagaaccggggctcctgcagccgcccgcagctctgtgtctgccgctctggtttccgtggagcccgctgcgaggaggtcattcccgatgaggaatttgacccccagaactccaggctggcacctcgacgctgggccgagcgttcacccaacctgcgcaggagcagtgcggctggagagggcaccttggccagagcacagccgccagcaccacagtcgccgcccgcaccacagtcgccaccagctgggaccctgagtggcctcagccagacccacccttcccagcagcacgtggggttgtcccgcactgtccgacttcacccgactgccacggccagtagccagctctcttccaacgccctgcccccgggaccaggccttgagcagagagatggcacccaacaggcggtacctctggagcacccctcatccccctgggggctgaacctcacggagaaaatcaagaagatcaagatcgtcttcactcccaccatctgcaagcagacctgtgcccgtggacactgtgccaacagctgtgagaggggcgacaccaccaccctgtacagccagggcggccatgggcacgatcccaagtctggcttccgcatctatttctgccagatcccctgcctgaacggaggccgctgcatcggcagggacgaatgctggtgccccgccaactccaccgggaagttctgccacctgcctatcccgcagccggacagggagcctccagggagggggtcccgccccagggccttgctggaagccccactgaagcagtccactttcacactgccgctctccaaccagctggcctccgtgaacccctccctggtgaaggtgcacattcaccacccacccgaggcctcagtgcagatccaccaggtggcccaggtgcggggcggggtggaggaggccctagtggagaacagcgtggagaccagacccccgccctggctgcctgccagccctggccacagcctctgggacagcaacaacatccctgctcggtctggagagccccctcggccactgcccccagcagcacccaggcctcgaggactgctgggccggtgttacctgaacactgtgaacggacagtgtgccaaccctctgctggagctgactacccaggaggactgctgtggcagtgtgggagccttctggggggtgactttgtgtgccccatgcccacccagaccagcctccccggtgattgagaatggccagctggagtgtcctcaggggtacaagagactgaacctcactcactgccaagatatcaacgagtgcttgaccctgggcctgtgcaaggacgcggagtgtgtgaataccaggggcagctacctgtgcacatgcagacctggcctcatgctggatccatcgcggagccgctgtgtgtcggacaaggcaatctccatgctgcagggactgtgctaccggtcgctggggcccggcacctgcaccctgcctttggcccagcggatcaccaagcagatatgctgctgcagccgcgtgggcaaagcatggggcagcgagtgtgagaaatgccctctgcctggcacagaggccttcagagagatctgccctgccggccacggctacacctacgcgagctccgacatccgcctgtccatgaggaaagccgaggaggaggaactggcaaggcccccaagggagcaagggcagaggagcagcggggcactgcccgggccagcagagaggcagcccctccgggtcgtcacggacacctggcttgaggccgggaccatccctgacaagggtgactctcaggctggccaggtcacgaccagtgtcactcatgcacctgcctgggtcacagggaatgccacaaccccaccaatgcctgaacaggggattgcagagatacaggaagaacaagtgaccccctccactgatgtgctggtgaccctgagcaccccaggcattgacagatgcgctgctggagccaccaacgtctgtggccctggaacctgcgtgaacctccccgatggatacagatgtgtctgcagccctggctaccagctgcaccccagccaggcctactgcacagatgacaacgagtgtctgagggacccctgcaagggaaaagggcgctgcatcaaccgcgtggggtcctactcctgcttctgctaccctggctacactctggccacctcaggggcgacacaggagtgtcaagatatcaatgagtgtgagcagccaggggtgtgcagcggggggcagtgcaccaacaccgagggctcgtaccactgcgagtgtgatcagggctacatcatggtcaggaaaggacactgccaagatatcaacgaatgccgtcaccccggtacctgccctgatgggagatgcgtcaattcccctggctcctacacttgtctggcctgtgaggagggctaccggggccagagtgggagctgtgtagatgtgaatgagtgtctgactcccggggtctgtgcccatggaaagtgcaccaacctagaaggctccttcagatgctcttgtgagcagggctatgaggtcacctcagatgagaagggctgccaagatgtggatgagtgtgccagccgggcctcatgccccacaggcctctgcctcaacacggagggctccttcgcctgctctgcctgtgagaacgggtactgggtgaatgaagacggcactgcctgtgaagacctagatgagtgtgccttcccgggagtctgcccctccggagtctgcaccaacacggctggctccttctcctgcaaggactgcgatgggggctaccggcccagccccctgggtgactcctgtgaagatgtggatgaatgtgaagacccccagagcagctgcctgggaggcgagtgcaagaacactgtgggctcctaccagtgcctctgtccccagggcttccagctggccaatggcaccgtgtgtgaggatgtgaatgagtgcatgggggaggagcactgcgcaccccacggcgagtgcctcaacagccacgggtctttcttctgtctgtgcgcgcctggcttcgtcagcgcagaggggggcaccagctgccaggatgtggacgagtgtgccaccacagacccgtgtgtgggagggcactgtgtcaacaccgagggctccttcaactgtctatgtgagactggcttccagccctccccagagagtggagagtgtgtggacatagacgagtgcgccaacgacaccatgtgtggcagccacggcttctgtgacaacactgatggctccttccgctgcctctgtgaccagggcttcgagatctctccctcaggctgggactgtgtggatgtgaacgagtgtgagcttatgctggcggtatgtggggccgcgctctgtgagaacgtggagggctccttcctgtgcctctgtgccagtgacctggaggagtacgatgcccaggaggggcactgccgcccacggggggctggaggtcagagtatgtctgaggccccaacgggggaccatgccccggcccccacccgcatggactgctactccgggcagaagggccatgcgccctgctccagtgtcctgggccggaacaccacacaggctgaatgctgctgcacccagggcgctagctggggagatgcctgtgacctctgcccgtctgaggactcagctgaattcagcgagatctgccctagtggaaaaggctacattcctgtggaaggagcctggacgtttggacagaccatgtacacagatgcggatgagtgtgtgatattcgggcctggtctctgcccgaacggccggtgcctcaacaccgtgcctggttatgtctgcctgtgcaatcccggcttccactacgatgcttcccacaagaagtgtgaggatcacgatgagtgccaggacctggcctgtgagaatggcgagtgcgtcaacacggagggctccttccactgcttctgcagccccccgctcaccctggacctcagccagcagcgctgcatgaacagcaccagcagcacggaggacctccctgaccacgacatccacatggacatctgctggaaaaaagtcaccaatgatgtgtgcagcgaacccctgcgtgggcaccgcaccacctacacggaatgctgctgccaggacggcgaggcctggagccagcagtgtgctctgtgtcccccgaggagctctgaggtctatgctcagctgtgcaacgtggctcgcattgaggcagagcgggaggccggggtccacttccggccaggctatgagtatggccccgggcccgatgacctgcactacagcatctatggcccagatggggcccccttctacaactacctgggccccgaggacaccgtccctgagcctgccttccccaacacagccggtcactcagcggaccgcacacccatccttgagtctcctttgcagccctcagaactccagccccactacgtggccagccatccagagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctc

SEQ ID NO: 147555 - DNA, 6462 bp, Homo sapiens
  Payload ID: 9199
  Gene Symbol: LTBP2
  Gene Name: latent transforming growth factor beta binding protein 2
  ENST ID: ENST00000553939
  CDS Start-End: 435-5744
tcgccgcccgctggcttcccggtgccaaagtgggtgttgctggaattcctcgctccctctccggtaatgagggggctgagctgtccctccgaggagggggcctggtgtggataaaagagacgaaaaagccgggggaggtttccaaaaataaaaccgtccgggtccccttcagacggctgcaggcacagggaggaggcgcgaaggtgcagcagccgtgcgagcccagctggagtaggagcgcggactcgaggctcggggcgcgcagccctcgttccgccgagagccgggcccccagtcggccgcttcagggccccctagactcagagaagctggccgccgggcggggccgggagaacagcccgcgggcgtccagcgtgccgaccacaaagctcttcgcggtgcccgcgcgcaccactctccagccgccccgcgccatgaggccgcggaccaaagcccgcagcccggggcgcgccctgcggaacccctggagaggcttcctgccgctcaccctggctctcttcgtgggcgcgggtcatgcccaaagggaccccgtagggagatacgagccggctggtggagacgcgaatcgactgcggcgccctgggggcagctacccggcagcggctgcagccaaggtgtacagtctgttccgggagcaggacgcgcctgtcgcgggcttgcagcccgtggagcgggcccagccgggctgggggagccccaggaggcccaccgaggcggaggccaggaggccgtcccgcgcgcagcagtcgcggcgtgtccagccacctgcgcagacccggagaagcactcccctgggccagcagcaaccagcaccccggacccgggccgcgccggctctcccacgcctggggaccccacagcggtctggggctgcgcccccaaccccgccgcgagggcggctcacggggaggaacgtctgcgggggacagtgctgcccaggatggacaacagcaaacagcaccaaccactgtatcaaacccgtttgcgagccgccgtgccagaaccggggctcctgcagccgcccgcagctctgtgtctgccgctctggtttccgtggagcccgctgcgaggaggtcattcccgatgaggaatttgacccccagaactccaggctggcacctcgacgctgggccgagcgttcacccaacctgcgcaggagcagtgcggctggagagggcaccttggccagagcacagccgccagcaccacagtcgccgcccgcaccacagtcgccaccagctgggaccctgagtggcctcagccagacccacccttcccagcagcacgtggggttgtcccgcactgtccgacttcacccgactgccacggccagtagccagctctcttccaacgccctgcccccgggaccaggccttgagcagagagatggcacccaacaggcggtacctctggagcacccctcatccccctgggggctgaacctcacggagaaaatcaagaagatcaagatcgtcttcactcccaccatctgcaagcagacctgtgcccgtggacactgtgccaacagctgtgagaggggcgacaccaccaccctgtacagccagggcggccatgggcacgatcccaagtctggcttccgcatctatttctgccagatcccctgcctgaacggaggccgctgcatcggcagggacgaatgctggtgccccgccaactccaccgggaagttctgccacctgcctatcccgcagccggacagggagcctccagggagggggtcccgccccagggccttgctggaagccccactgaagcagtccactttcacactgccgctctccaaccagctggcctccgtgaacccctccctggtgaaggtgcacattcaccacccacccgaggcctcagtgcagatccaccaggtggcccaggtgcggggcggggtggaggaggccctagtggagaacagcgtggagaccagacccccgccctggctgcctgccagccctggccacagcctctgggacagcaacaacatccctgctcggtctggagagccccctcggccactgcccccagcagcacccaggcctcgaggactgctgggccggtgttacctgaacactgtgaacggacagtgtgccaaccctctgctggagctgactacccaggaggactgctgtggcagtgtgggagccttctggggggtgactttgtgtgccccatgcccacccagaccagcctccccggtgattgagaatggccagctggagtgtcctcaggggtacaagagactgaacctcactcactgccaagatatcaacgagtgcttgaccctgggcctgtgcaaggacgcggagtgtgtgaataccaggggcagctacctgtgcacatgcagacctggcctcatgctggatccatcgcggagccgctgtgtgtcggacaaggcaatctccatgctgcagggactgtgctaccggtcgctggggcccggcacctgcaccctgcctttggcccagcggatcaccaagcagatatgctgctgcagccgcgtgggcaaagcatggggcagcgagtgtgagaaatgccctctgcctggcacagaggccttcagagagatctgccctgccggccacggctacacctacgcgagctccgacatccgcctgtccatgaggaaagccgaggaggaggaactggcaaggcccccaagggagcaagggcagaggagcagcggggcactgcccgggccagcagagaggcagcccctccgggtcgtcacggacacctggcttgaggccgggaccatccctgacaagggtgactctcaggctggccaggtcacgaccagtgtcactcatgcacctgcctgggtcacagggaatgccacaaccccaccaatgcctgaacaggggattgcagagatacaggaagaacaagtgaccccctccactgatgtgctggtgaccctgagcaccccaggcattgacagatgcgctgctggagccaccaacgtctgtggccctggaacctgcgtgaacctccccgatggatacagatgtgtctgcagccctggctaccagctgcaccccagccaggcctactgcacagatgacaacgagtgtctgagggacccctgcaagggaaaagggcgctgcatcaaccgcgtggggtcctactcctgcttctgctaccctggctacactctggccacctcaggggcgacacaggagtgtcaagatatcaatgagtgtgagcagccaggggtgtgcagcggggggcagtgcaccaacaccgagggctcgtaccactgcgagtgtgatcagggctacatcatggtcaggaaaggacactgccaagatatcaacgaatgccgtcaccccggtacctgccctgatgggagatgcgtcaattcccctggctcctacacttgtctggcctgtgaggagggctaccggggccagagtgggagctgtgtagatgtgaatgagtgtctgactcccggggtctgtgcccatggaaagtgcaccaacctagaaggctccttcagatgctcttgtgagcagggctatgaggtcacctcagatgagaagggctgccaagatgtggatgagtgtgccagccgggcctcatgccccacaggcctctgcctcaacacggagggctccttcgcctgctctgcctgtgagaacgggtactgggtgaatgaagacggcactgcctgtgaagacctagatgagtgtgccttcccgggagtctgcccctccggagtctgcaccaacacggctggctccttctcctgcaaggactgcgatgggggctaccggcccagccccctgggtgactcctgtgaagatgtggatgaatgtgaagacccccagagcagctgcctgggaggcgagtgcaagaacactgtgggctcctaccagtgcctctgtccccagggcttccagctggccaatggcaccgtgtgtgaggatgtgaatgagtgcatgggggaggagcactgcgcaccccacggcgagtgcctcaacagccacgggtctttcttctgtctgtgcgcgcctggcttcgtcagcgcagaggggggcaccagctgccaggatgtggacgagtgtgccaccacagacccgtgtgtgggagggcactgtgtcaacaccgagggctccttcaactgtctatgtgagactggcttccagccctccccagagagtggagagtgtgtggatattgacgagtgtgaggactatggagacccggtgtgtggcacctggaagtgtgaaaacagccctggctcctaccgctgtgttctgggctgccagcctggcttccacatggccccgaacggagactgcattgacatagacgagtgcgccaacgacaccatgtgtggcagccacggcttctgtgacaacactgatggctccttccgctgcctctgtgaccagggcttcgagatctctccctcaggctgggactgtgtggatgtgaacgagtgtgagcttatgctggcggtatgtggggccgcgctctgtgagaacgtggagggctccttcctgtgcctctgtgccagtgacctggaggagtacgatgcccaggaggggcactgccgcccacggggggctggaggtcagagtatgtctgaggccccaacgggggaccatgccccggcccccacccgcatggactgctactccgggcagaagggccatgcgccctgctccagtgtcctgggccggaacaccacacaggctgaatgctgctgcacccagggcgctagctggggagatgcctgtgacctctgcccgtctgaggactcagctgaattcagcgagatctgccctagtggaaaaggctacattcctgtggaaggagcctggacgtttggacagaccatgtacacagatgcggatgagtgtgtgatattcgggcctggtctctgcccgaacggccggtgcctcaacaccgtgcctggttatgtctgcctgtgcaatcccggcttccactacgatgcttcccacaagaagtgtgaggatcacgatgagtgccaggacctggcctgtgagaatggcgagtgcgtcaacacggagggctccttccactgcttctgcagccccccgctcaccctggacctcagccagcagcgctgcatgaacagcaccagcagcacggaggacctccctgaccacgacatccacatggacatctgctggaaaaaagtcaccaatgatgtgtgcagcgaacccctgcgtgggcaccgcaccacctacacggaatgctgctgccaggacggcgaggcctggagccagcagtgtgctctgtgtcccccgaggagctctgaggtctatgctcagctgtgcaacgtggctcgcattgaggcagagcgggaggccggggtccacttccggccaggctatgagtatggccccgggcccgatgacctgcactacagcatctatggcccagatggggcccccttctacaactacctgggccccgaggacaccgtccctgagcctgccttccccaacacagccggtcactcagcggaccgcacacccatccttgagtctcctttgcagccctcagaactccagccccactacgtggccagccatccaggtctgtgttgctgcaaaactggggaagaggtgggcaccaaagctgtttcacttccatctcctccacctgctagtcatattgccagcaggagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctctggctgtaagcttcggtcattgcctccatgcccttgcttggctcaagcaccaccaatcgctttaatgcttcagccaccgcatgaggccctgtccaccacctttcctggccttgctatgggatgcttaccaaaggatggccctcatccaccctcccaagctgtgcgagcatgcaaggccccatggcctcacactgcagacacccctttccagccacaatccaccatcatcctgacgatcccacaactgggacagaggctacatctgccctagggaggtccttcagaatctgtggagcaagaaaggatttggggaagcttggg

SEQ ID NO: 147556 - DNA, 4443 bp, Homo sapiens
  Payload ID: 9200
  Gene Symbol: LTBP3
  Gene Name: latent transforming growth factor beta binding protein 3
  Uniprot ID: Q9NS15
  ENST ID: ENST00000301873
  CDS Start-End: 270-4181
cttgctccggcctcctcgctcctgcctgagttcggggcctggtctgggcttcgtcctggggctgggaagtttctgcgctccccgctgtccagtctgcatctccgcgcctcccgccgggcccccgcggtcccctcccgcccgcttcccccgctgccctccctcgctgccccctaccctctcccggggctcccggccctctactcccttcgggcgcgggcccctcgccccgcccgggcgcgccccccctcccccgggtcctgcggccccggatgcccgggccccgaggggctgctggcggcctggcccctgagatgcgcggggcgggggcggcggggctgctggcgctgctgctgctgctgctgctgctgctgctgggcctgggcggcagggtcgagggggggccggccggcgagcggggcgcaggcgggggcggggcgctggcccgcgagcgcttcaaggtggtctttgcgccggtgatctgcaagcggacctgtctcaagggccagtgtcgggacagttgtcagcagggctccaacatgacgctcatcggagagaacggccacagcacagacacgctcacgggctccggcttccgcgtggtggtgtgccctctcccctgcatgaatggcggccagtgctcctcgcgaaaccagtgcctgtgtcccccggacttcactgggcgcttctgccaggtgcccgcaggaggagccggtgggggtaccggcggctcaggccccggcctgagcaggacaggggccctgtccacaggggcgctgccgcccctggctccggagggcgactctgtggccagcaagcacgccatctacgccgtccaggtgatcgctgaccctcctgggcccggggaggggcctcctgcccagcacgcagccttcctggtgcccctaggcccgggacagatctcagcagaagtgcaggccccgccccccgtggtgaatgtgcgcgtccatcacccgcccgaggcctcagtccaggtgcaccgcattgagagctcgaacgccgagagcgcagccccctcccagcacctgctgccgcaccccaagccctcgcacccccggccgcccacccagaagcccctgggccgctgctttcaggacactctgcccaagcagccgtgtggcagcaaccccctccccggcctcaccaagcaggaagactgctgcggtagcatcggcactgcctggggccagagcaagtgccacaagtgtccccagctgcagtacacaggagtgcagaagccagggcctgtacgtggggaagtgggcgctgactgtccccagggctacaagaggcttaacagcacccactgccaggacatcaacgagtgcgcaatgccgggcgtgtgtcgccatggtgactgcctcaacaaccctggctcctatcgctgtgtctgcccacctggccatagtttaggcccctcccgtacacagtgcattgcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggggtgaccacggactcaccggtgagtgaggagaggtcagtgcagcagagccacccaactgccaccacgactcctgcccggccctaccccgagctgatctcccgtccctcgcccccgaccatgcgctggttcctgccggacttgcctccttcccgcagcgccgtagagatcgctcccactcaggtcacagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgaggcagagccctgtggcccggggaggggcatctgcatgaacaccggcggctcctacaattgccactgcaaccgcggctaccgcctgcacgtgggcgccggggggcgctcgtgcgtggacctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggacgtggacgagtgccaggacccggcagcctgccgccctggccgctgcgtcaacctgccgggctcctaccgctgcgagtgtcgcccgccctgggtgcccgggccctccggccgcgattgccagctccccgagagcccggccgagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctcggacccagggaccttcagggcccgcagaccctcccggcgccttgagacccgaggcgcccctaccggcccccctccccggttagcgggcggttgtaaggtctccggcgggcgctgcctgccttcctcccagagggtgtttcctagaaactgataaatcagatcgtgcctcttta

SEQ ID NO: 147557 - DNA, 4046 bp, Homo sapiens
  Payload ID: 9200
  Gene Symbol: LTBP3
  Gene Name: latent transforming growth factor beta binding protein 3
  Uniprot ID: Q9NS15
  ENST ID: ENST00000322147
  CDS Start-End: 1-3771
atgcccgggccccgaggggctgctggcggcctggcccctgagatgcgcggggcgggggcggcggggctgctggcgctgctgctgctgctgctgctgctgctgctgggcctgggcggcagggtcgagggggggccggccggcgagcggggcgcaggcgggggcggggcgctggcccgcgagcgcttcaaggtggtctttgcgccggtgatctgcaagcggacctgtctcaagggccagtgtcgggacagttgtcagcagggctccaacatgacgctcatcggagagaacggccacagcacagacacgctcacgggctccggcttccgcgtggtggtgtgccctctcccctgcatgaatggcggccagtgctcctcgcgaaaccagtgcctgtgtcccccggacttcactgggcgcttctgccaggtgcccgcaggaggagccggtgggggtaccggcggctcaggccccggcctgagcaggacaggggccctgtccacaggggcgctgccgcccctggctccggagggcgactctgtggccagcaagcacgccatctacgccgtccaggtgatcgctgaccctcctgggcccggggaggggcctcctgcccagcacgcagccttcctggtgcccctaggcccgggacagatctcagcagaagtgcaggccccgccccccgtggtgaatgtgcgcgtccatcacccgcccgaggcctcagtccaggtgcaccgcattgagagctcgaacgccgagagcgcagccccctcccagcacctgctgccgcaccccaagccctcgcacccccggccgcccacccagaagcccctgggccgctgctttcaggacactctgcccaagcagccgtgtggcagcaaccccctccccggcctcaccaagcaggaagactgctgcggtagcatcggcactgcctggggccagagcaagtgccacaagtgtccccagctgcagtacacaggagtgcagaagccagggcctgtacgtggggaagtgggcgctgactgtccccagggctacaagaggcttaacagcacccactgccaggacatcaacgagtgcgcaatgccgggcgtgtgtcgccatggtgactgcctcaacaaccctggctcctatcgctgtgtctgcccacctggccatagtttaggcccctcccgtacacagtgcattgcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggggtgaccacggactcaccggtgagtgaggagaggtcagtgcagcagagccacccaactgccaccacgactcctgcccggccctaccccgagctgatctcccgtccctcgcccccgaccatgcgctggttcctgccggacttgcctccttcccgcagcgccgtagagatcgctcccactcaggtcacagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgaggcagagccctgtggcccggggaggggcatctgcatgaacaccggcggctcctacaattgccactgcaaccgcggctaccgcctgcacgtgggcgccggggggcgctcgtgcgtggacctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctcggacccagggaccttcagggcccgcagaccctcccggcgccttgagacccgaggcgcccctaccggcccccctccccggttagcgggcggttgtaaggtctccggcgggcgctgcctgccttcctcccagagggtgtttcctagaaactgataaatcagatcgtgcctctttacccttggctttcg

SEQ ID NO: 147558 - DNA, 2750 bp, Homo sapiens
  Payload ID: 9200
  Gene Symbol: LTBP3
  Gene Name: latent transforming growth factor beta binding protein 3
  ENST ID: ENST00000526927
  CDS Start-End: 1-2722
ctttgcgccggtgatctgcaagcggacctgtctcaagggccagtgtcgggacagttgtcagcagggctccaacatgacgctcatcggagagaacggccacagcacagacacgctcacgggctccggcttccgcgtggcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggggtgaccacggactcaccggtgagtgaggagaggtcagtgcagcagagccacccaactgccaccacgactcctgcccggccctaccccgagctgatctcccgtccctcgcccccgaccatgcgctggttcctgccggacttgcctccttcccgcagcgccgtagagatcgctcccactcaggtcacagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgaggcagagccctgtggcccggggaggggcatctgcatgaacaccggcggctcctacaattgccactgcaaccgcggctaccgcctgcacgtgggcgccggggggcgctcgtgcgtggacctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagac

SEQ ID NO: 147559 - DNA, 619 bp, Homo sapiens
  Payload ID: 9200
  Gene Symbol: LTBP3
  Gene Name: latent transforming growth factor beta binding protein 3
  ENST ID: ENST00000527339
  CDS Start-End: 1-423
ctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttgggtgagcgccagcacccccgccccgggcctccgccgccccctacgcgctgaagccggggagcgggtcacgctgtctgtaaacagtgggtggaaggtggctcattcatccccaggtgactctgctcactcattttctcaacgaactttgccaaggaaggcaccactagaatttccacgtaggaagggtctcggggtagagctcgaagctgcgtttgcaaagcatgttacttaaatttgaaggaaaaaa

SEQ ID NO: 147560 - DNA, 3935 bp, Homo sapiens
  Payload ID: 9200
  Gene Symbol: LTBP3
  Gene Name: latent transforming growth factor beta binding protein 3
  ENST ID: ENST00000528516
  CDS Start-End: 80-430
cggccctctactcccttcgggcgcgggcccctcgccccgcccgggcgcgccccccctcccccgggtcctgcggccccggatgcccgggccccgaggggctgctggcggcctggcccctgagatgcgcggggcgggggcggcggggctgctggcgctgctgctgctgctgctgctgctgctgctgggcctgggcggcagggtcgagggggggccggccggcgagcggggcgcaggcgggggcggggcgctggcccgcgagcgcttcaaggtggtctttgcgccggtgatctgcaagcggacctgtctcaagggccagtgtcgggacagttgtcagcagggctccaacatgacgctcatcggagagaacggccacagcacagacacgctcacgggctccggcttccgctggtgtgccctctcccctgcatgaatggcggccagtgctcctcgcgaaaccagtgcctgtgtcccccggacttcactgggcgcttctgccaggtgcccgcaggaggagccggtgggggtaccggcggctcaggccccggcctgagcaggacaggggccctgtccacaggggcgctgccgcccctggctccggagggcgactctgtggccagcaagcacgccatctacgccgtccaggtgatcgctgaccctcctgggcccggggaggggcctcctgcccagcacgcagccttcctggtgcccctaggcccgggacagatctcagcagaagtgcaggccccgccccccgtggtgaatgtgcgcgtccatcacccgcccgaggcctcagtccaggtgcaccgcattgagagctcgaacgccgagagcgcagccccctcccagcacctgctgccgcaccccaagccctcgcacccccggccgcccacccagaagcccctgggccgctgctttcaggacactctgcccaagcagccgtgtggcagcaaccccctccccggcctcaccaagcaggaagactgctgcggtagcatcggcactgcctggggccagagcaagtgccacaagtgtccccagctgcagtacacaggagtgcagaagccagggcctgtacgtggggaagtgggcgctgactgtccccagggctacaagaggcttaacagcacccactgccaggacatcaacgagtgcgcaatgccgggcgtgtgtcgccatggtgactgcctcaacaaccctggctcctatcgctgtgtctgcccacctggccatagtttaggcccctcccgtacacagtgcattgcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggggtgaccacggactcaccggtgagtgaggagaggtcagtgcagcagagccacccaactgccaccacgactcctgcccggccctaccccgagctgatctcccgtccctcgcccccgaccatgcgctggttcctgccggacttgcctccttcccgcagcgccgtagagatcgctcccactcaggtcacagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgaggcagagccctgtggcccggggaggggcatctgcatgaacaccggcggctcctacaattgccactgcaaccgcggctaccgcctgcacgtgggcgccggggggcgctcgtgcgtggacctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctc

SEQ ID NO: 147561 - DNA, 431 bp, Homo sapiens
  Payload ID: 9200
  Gene Symbol: LTBP3
  Gene Name: latent transforming growth factor beta binding protein 3
  ENST ID: ENST00000530426
  CDS Start-End: 1-431
tttcaggacactctgcccaagcagccgtgtggcagcaaccccctccccggcctcaccaagcaggaagactgctgcggtagcatcggcactgcctggggccagagcaagtgccacaagtgtccccagctgcagtacacaggagtgcagaagccagggcctgtacgtggggaagtgggcgctgactgtccccagggctacaagaggcttaacagcacccactgccaggcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattct

SEQ ID NO: 147562 - DNA, 2461 bp, Homo sapiens
  Payload ID: 9200
  Gene Symbol: LTBP3
  Gene Name: latent transforming growth factor beta binding protein 3
  ENST ID: ENST00000530785
  CDS Start-End: 1280-2200
gtgaagggcctgggttgagtaggggactcaggagaacagtggcggtttggaagtatcccagggcatggggctgcctaggggctttatggaagtcaaagctttagaggagtcagagagggaggtgccagccacacgaggctctgttggactgaggctgaagcctgtgggtatgttccagcatgctcagcttggtggctgctccagtcccactccgcacccaggatccacaggccacagctctgaccagagactgggcattgccagacagtgaggaggaaggagaggtgtttatggatcagggacgggagtcctagggatgataagccctgggctccagctgggaactatcagagtctgggggtgtcaggcaagctcggaggactgagagggaggccaccaagccctgtgagagagaaggtggaggtgaggacttgagaacagtggaaagaaggcagcctctgagggccccagggtggagcagatctgagtgatgaaaatccccttgggaccctgagagtgaggggaaggtcacggaagccgagagatccaggaatgtgaggtcagaggctgacctggttgtccacgcggatgttcgaaactcccaggatggagagaaaaacagagcaggaggaatgaggaagatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggacgtggacgagtgccaggacccggcagcctgccgccctggccgctgcgtcaacctgccgggctcctaccgctgcgagtgtcgcccgccctgggtgcccgggccctccggccgcgattgccagctccccgagagcccggccgagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctcggacccagggaccttcagggcccgcagaccctcccggcgccttgagacccgaggcgcccctaccggcccccctccccggttagcgggcggttgtaaggtctccggcgggcgctgcctgccttcctcccagagggtgtttcctagaaactgataaatcagatcgtgcctcttt

SEQ ID NO: 147563 - DNA, 1997 bp, Homo sapiens
  Payload ID: 9200
  Gene Symbol: LTBP3
  Gene Name: latent transforming growth factor beta binding protein 3
  ENST ID: ENST00000529189
  CDS Start-End: 957-1736
aggtgcctcccccagtctggctccgctgggggcggggcggggtagcggtggtgattggcgtctgggggcggggccttccgggagtagaggctgccctctcaaccccgcgttccagggaagagacccacacccccgcgaggtgcgcggtccgccttccggtggggcagagtccgaggctaggtctttccgccgcagacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctcggacccagggaccttcagggcccgcagaccctcccggcgccttgagacccgaggcgcccctaccggcccccctccccggttagcgggcggttgtaaggtctccggcgggcgctgcctgccttcctcccagagggtgtttcctagaaactgataaatcagatcgtgcctcttt

SEQ ID NO: 147564 - DNA, 1002 bp, Homo sapiens
  Payload ID: 9200
  Gene Symbol: LTBP3
  Gene Name: latent transforming growth factor beta binding protein 3
  ENST ID: ENST00000526825
  CDS Start-End: 1-208
ctttgcgccggtgatctgcaagcggacctgtctcaagggccagtgtcgggacagttgtcagcagggctccaacatgacgctcatcggagagaacggccacagcacagacacgctcacgggctccggcttccgcgtgggccccgccccccgtggtgaatgtgcgcgtccatcacccgcccgaggcctcagtccaggtgcaccgcattgagagctcgaacgccgagagcgcagccccctcccagcacctgctgccgcaccccaagccctcgcacccccggccgcccacccagaagcccctgggccgctgctttcaggacactctgcccaagcagccgtgtggcagcaaccccctccccggcctcaccaagcaggaagactgctgcggtagcatcggcactgcctggggccagagcaagtgccacaagtgtccccagctgcagtacacaggagtgcagaagccagggcctgtacgtggggaagtgggcgctgactgtccccagggctacaagaggcttaacagcacccactgccaggacatcaacgagtgcgcaatgccgggcgtgtgtcgccatggtgactgcctcaacaaccctggctcctatcgctgtgtctgcccacctggccatagtttaggcccctcccgtacacagtgcattgcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagag

SEQ ID NO: 147565 - DNA, 3756 bp, Homo sapiens
  Payload ID: 9200
  Gene Symbol: LTBP3
  Gene Name: latent transforming growth factor beta binding protein 3
  ENST ID: ENST00000530866
  CDS Start-End: 347-3756
ttctttctgctcctcttctggaccccacagacttcctcctgggacctccgtgagccctggccaaaggctgtccccaccctttagccctttcctcagaggggattggaccagcactaacgagaagttactttggggccctgagacccccacgtttgcaagggaggctgggaaagagctggaaggcctgggctccggctccacccggcctccatcgtcagtgtgacccggcagggccacctctctccctcagcctcggtatctcgctctacgcaggcctccccgccccgccccgcccggaggaatccgcggccggccagacggtcccagttgtcagcagggctccaacatgacgctcatcggagagaacggccacagcacagacacgctcacgggctccggcttccgcgtggtggtgtgccctctcccctgcatgaatggcggccagtgctcctcgcgaaaccagtgcctgtgtcccccggacttcactgggcgcttctgccaggtgcccgcaggaggagccggtgggggtaccggcggctcaggccccggcctgagcaggacaggggccctgtccacaggggcgctgccgcccctggctccggagggcgactctgtggccagcaagcacgccatctacgccgtccaggtgatcgctgaccctcctgggcccggggaggggcctcctgcccagcacgcagccttcctggtgcccctaggcccgggacagatctcagcagaagtgcaggccccgccccccgtggtgaatgtgcgcgtccatcacccgcccgaggcctcagtccaggtgcaccgcattgagagctcgaacgccgagagcgcagccccctcccagcacctgctgccgcaccccaagccctcgcacccccggccgcccacccagaagcccctgggccgctgctttcaggacactctgcccaagcagccgtgtggcagcaaccccctccccggcctcaccaagcaggaagactgctgcggtagcatcggcactgcctggggccagagcaagtgccacaagtgtccccagctgcagtacacaggagtgcagaagccagggcctgtacgtggggaagtgggcgctgactgtccccagggctacaagaggcttaacagcacccactgccaggacatcaacgagtgcgcaatgccgggcgtgtgtcgccatggtgactgcctcaacaaccctggctcctatcgctgtgtctgcccacctggccatagtttaggcccctcccgtacacagtgcattgcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggggtgaccacggactcaccggtgagtgaggagaggtcagtgcagcagagccacccaactgccaccacgactcctgcccggccctaccccgagctgatctcccgtccctcgcccccgaccatgcgctggttcctgccggacttgcctccttcccgcagcgccgtagagatcgctcccactcaggtcacagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgaggcagagccctgtggcccggggaggggcatctgcatgaacaccggcggctcctacaattgccactgcaaccgcggctaccgcctgcacgtgggcgccggggggcgctcgtgcgtggacctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggacgtggacgagtgccaggacccggcagcctgccgccctggccgctgcgtcaacctgccgggctcctaccgctgcgagtgtcgcccgccctgggtgcccgggccctccggccgcgattgccagctccccgagagcccggccgagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtgg

SEQ ID NO: 147566 - DNA, 3327 bp, Homo sapiens
  Payload ID: 9200
  Gene Symbol: LTBP3
  Gene Name: latent transforming growth factor beta binding protein 3
  ENST ID: ENST00000532932
  CDS Start-End: 865-3066
gagctcctagggttagggctcaggtgggagatggctgttcttgggggctttgggaatgtggacaaggcccctcaaaggaggggctgttaaggaagcctaaggagaggtactccaggcaaagagaacagcctgcaaagcccactggccaggtgagtttggggcagagcagagttcactgttatggcccaggctgcatggcaggagtgagggggaaggggtgtgggaaatgaaactggtgagcagtgaggatccaaaggaggggagaggctggaggcagggagtcctgggcttggtgacaaagagagtgaggggggtggttcctggatctgactgcctgtgcacagctttggcactagttaggattcccaggaaaccagctcctgctagtcttgggagggggtaatcaacccttctggaatagggggtcgggtccctggggcaagggcttatggagtcactgggctagaggacactggtgtgaccgaggctatagagtttaaggtattgaggcgactggggagaaaggagttttagtcccttgggtgggagtactgggacgactgaggggccctgaggggatgtggtttggtttgaggtgagtggggtcagggtcttggagtgaaccgggaatggaagtatccgggcctgggtgtggggtgatacggctgtcaggggcctggagtcctagtttggagctttctggggtcttgatattggggttatctaaaagagagaaataggacatcctggagttggagtatgggcgtacaggaacctgaggtcatggtgtgactggggtgttgaggtctgccctggggatatggcagaaggtgagcgctccctgctctgccgcttgacctggccatgcccgcagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgaggcagagccctgtggcccggggaggggcatctgcatgaacaccggcggctcctacaattgccactgcaaccgcggctaccgcctgcacgtgggcgccggggggcgctcgtgcgtggacctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggacgtggacgagtgccaggacccggcagcctgccgccctggccgctgcgtcaacctgccgggctcctaccgctgcgagtgtcgcccgccctgggtgcccgggccctccggccgcgattgccagctccccgagagcccggccgagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctcggacccagggaccttcagggcccgcagaccctcccggcgccttgagacccgaggcgcccctaccggcccccctccccggttagcgggcggttgtaaggtctccggcgggcgctgcctgccttcctcccagagggtgtttcctagaaactgataaatcagatcgtgcctcttt

SEQ ID NO: 147567 - DNA, 575 bp, Homo sapiens
  Payload ID: 9200
  Gene Symbol: LTBP3
  Gene Name: latent transforming growth factor beta binding protein 3
  ENST ID: ENST00000529371
  CDS Start-End: 205-575
ggcagggagacacgcgccaccgcgcccatcccgggcctgcccctgctacccacgcttttcctccctgcagacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccg

SEQ ID NO: 147568 - DNA, 748 bp, Homo sapiens
  Payload ID: 9200
  Gene Symbol: LTBP3
  Gene Name: latent transforming growth factor beta binding protein 3
  ENST ID: ENST00000532661
  CDS Start-End: 84-748
ggtgcgcccagcccacgcctccgggctgcagctgcgggaccggagcggccagtgtttgtcaccccgcagacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggct

SEQ ID NO: 147569 - DNA, 4700 bp, Homo sapiens
  Payload ID: 9200
  Gene Symbol: LTBP3
  Gene Name: latent transforming growth factor beta binding protein 3
  ENST ID: ENST00000536982
  CDS Start-End: 3261-4052
cttgctccggcctcctcgctcctgcctgagttcggggcctggtctgggcttcgtcctggggctgggaagtttctgcgctccccgctgtccagtctgcatctccgcgcctcccgccgggcccccgcggtcccctcccgcccgcttcccccgctgccctccctcgctgccccctaccctctcccggggctcccggccctctactcccttcgggcgcgggcccctcgccccgcccgggcgcgccccccctcccccgggtcctgcggccccggatgcccgggccccgaggggctgctggcggcctggcccctgagatgcgcggggcgggggcggcggggctgctggcgctgctgctgctgctgctgctgctgctgctgggcctgggcggcagggtcgagggggggccggccggcgagcggggcgcaggcgggggcggggcgctggcccgcgagcgcttcaaggtggtctttgcgccggtgatctgcaagcggacctgtctcaagggccagtgtcgggacagttgtcagcagggctccaacatgacgctcatcggagagaacggccacagcacagacacgctcacgggctccggcttccgcgtggtggtgtgccctctcccctgcatgaatggcggccagtgctcctcgcgaaaccagtgcctgtgtcccccggacttcactgggcgcttctgccaggtgcccgcaggaggagccggtgggggtaccggcggctcaggccccggcctgagcaggacaggggccctgtccacaggggcgctgccgcccctggctccggagggcgactctgtggccagcaagcacgccatctacgccgtccaggtgatcgctgaccctcctgggcccggggaggggcctcctgcccagcacgcagccttcctggtgcccctaggcccgggacagatctcagcagaagtgcaggccccgccccccgtggtgaatgtgcgcgtccatcacccgcccgaggcctcagtccaggtgcaccgcattgagagctcgaacgccgagagcgcagccccctcccagcacctgctgccgcaccccaagccctcgcacccccggccgcccacccagaagcccctgggccgctgctttcaggacactctgcccaagcagccgtgtggcagcaaccccctccccggcctcaccaagcaggaagactgctgcggtagcatcggcactgcctggggccagagcaagtgccacaagtgtccccagctgcagtacacaggagtgcagaagccagggcctgtacgtggggaagtgggcgctgactgtccccagggctacaagaggcttaacagcacccactgccaggacatcaacgagtgcgcaatgccgggcgtgtgtcgccatggtgactgcctcaacaaccctggctcctatcgctgtgtctgcccacctggccatagtttaggcccctcccgtacacagtgcattgcagacaaaccggaggagaagagcctgtgtttccgcctggtgagccctgagcaccagtgccagcacccactgaccacccgcctgacccgccagctctgctgctgcagtgtcggcaaggcctggggcgcgcggtgtcagcgctgcccaacagatggcaccgctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggggtgaccacggactcaccggtgagtgaggagaggtcagtgcagcagagccacccaactgccaccacgactcctgcccggccctaccccgagctgatctcccgtccctcgcccccgaccatgcgctggttcctgccggacttgcctccttcccgcagcgccgtagagatcgctcccactcaggtcacagagactgatgagtgccgactgaaccagaacatctgtggccacggagagtgcgtgccgggcccccctgactactcctgccactgcaaccccggctaccggtcacatccccagcaccgctactgcgtggatgtgaacgagtgcgaggcagagccctgtggcccggggaggggcatctgcatgaacaccggcggctcctacaattgccactgcaaccgcggctaccgcctgcacgtgggcgccggggggcgctcgtgcgtggacctgaacgaatgcgccaagccccacctgtgcggcgacggcggcttctgcatcaactttcccggtcactacaagtgcaactgctaccccggctaccggctcaaagcctcccggcctcctgtgtgcgaagacatcgacgagtgccgggacccaagctcttgcccggatggcaaatgcgagaacaagcccgggagcttcaagtgcatcgcctgtcagcctggctaccgcagccaggggggcggggcctgtcgcgacgtgaacgagtgcgccgagggcagcccctgctcgcctggctggtgcgagaacctcccgggctccttccgctgcacctgtgcccagggctacgcgcccgcgcccgacggccgcagttgcttggatgtggacgagtgtgaggctggggacgtgtgtgacaatggcatctgcagcaacacgccaggatctttccagtgtcagtgcctctctggctaccatctgtccagggaccggagccactgcgaggacattgatgagtgtgacttccctgcagcctgcattgggggtgactgcatcaataccaatggctcctacagatgtctttgcccccaggggcatcggctggtgggtggcaggaaatgccaagacatagatgagtgcagccaggacccgagcctgtgccttccccatggggcctgcaagaaccttcagggctcctatgtgtgtgtctgcgatgagggcttcactcccacccaggaccagcacggttgtgaggaggtggagcagccccaccacaagaaggagtgctacctgaacttcgatgacacagtgttctgcgacagcgtattggccaccaacgtgacccagcaggagtgctgctgctctctgggggccggctggggcgaccactgcgaaatctacccctgcccagtctacagctcagccgagttccacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggacgtggacgagtgccaggacccggcagcctgccgccctggccgctgcgtcaacctgccgggctcctaccgctgcgagtgtcgcccgccctgggtgcccgggccctccggccgcgattgccagctccccgagagcccggccgagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtgccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaagccggcttcgcgcgcagccgcccgcacggggcctgcgttccccagcgccgccgctgacgccgccgacgccgccctcggcccagacctcggtgatcactgagggatttccgcgagctcggcctcacttctgccccgacttgtggctcggacccagggaccttcagggcccgcagaccctcccggcgccttgagacccgaggcgcccctaccggcccccctccccggttagcgggcggttgtaaggtctccggcgggcgctgcctgccttcctcccagagggtgtttcctagaaactgataaatcagatcgtgcctctttacccttggctttcgaagcaaattgatgttcacgtctgacgtgggcgcgggctgcgcagggcggcgccagaccccagccgcctcccaggggctagactgagcccggcacaaggggtgtgaaatagaatttattgtggctctgattatgtacacgtgagatggcctggctgggccggccgggctcacatggtttgtacaataaatacatctgtggggcgggctctccgcagccgggaagggccaccgccacggttcagtcc

SEQ ID NO: 147570 - DNA, 5032 bp, Homo sapiens
  Payload ID: 9201
  Gene Symbol: LTBP4
  Gene Name: latent transforming growth factor beta binding protein 4
  ENST ID: ENST00000204005
  CDS Start-End: 1-4764
atgggagacgtaaaagcgttgctgtttgtcgctgctgcccgggccagacgtctaggaggagccgctgcatccgagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttcta

SEQ ID NO: 147571 - DNA, 3140 bp, Homo sapiens
  Payload ID: 9201
  Gene Symbol: LTBP4
  Gene Name: latent transforming growth factor beta binding protein 4
  ENST ID: ENST00000243562
  CDS Start-End: 1-2873
atgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttct

SEQ ID NO: 147572 - DNA, 4948 bp, Homo sapiens
  Payload ID: 9201
  Gene Symbol: LTBP4
  Gene Name: latent transforming growth factor beta binding protein 4
  Uniprot ID: Q8N2S1
  ENST ID: ENST00000308370
  CDS Start-End: 1-4875
atgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgctta

SEQ ID NO: 147573 - DNA, 4764 bp, Homo sapiens
  Payload ID: 9201
  Gene Symbol: LTBP4
  Gene Name: latent transforming growth factor beta binding protein 4
  Uniprot ID: Q8N2S1
  ENST ID: ENST00000396819
  CDS Start-End: 18-4691
agcgcggcgctgcagccatggcgggcggcgtgcggctgctctgggtgtcgctattggtgctgctggcgcagctagggccgcagcctggactgggccggctcggagagcgtctccgcgtgcgcttcaccccggtcgtgtgcggcctgcgctgcgtccatgggccgaccggctcccgctgtaccccgacctgcgcgccccgcaacgccaccagcgtggacagcggcgctcccggcggggcggccccggggggacccggcttccgcgccttcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgctta

SEQ ID NO: 147574 - DNA, 573 bp, Homo sapiens
  Payload ID: 9201
  Gene Symbol: LTBP4
  Gene Name: latent transforming growth factor beta binding protein 4
  ENST ID: ENST00000593463
  CDS Start-End: 1-573
acgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctgacgtggacgaatgtcagctcttccgagaccaggtgtgca

SEQ ID NO: 147575 - DNA, 910 bp, Homo sapiens
  Payload ID: 9201
  Gene Symbol: LTBP4
  Gene Name: latent transforming growth factor beta binding protein 4
  ENST ID: ENST00000599724
  CDS Start-End: 1-910
gagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctgacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggact

SEQ ID NO: 147576 - DNA, 2019 bp, Homo sapiens
  Payload ID: 9201
  Gene Symbol: LTBP4
  Gene Name: latent transforming growth factor beta binding protein 4
  ENST ID: ENST00000601032
  CDS Start-End: 1-2019
gaacacagaaggcagcttccagtgtgtctgccccatgggcttccaacccaacactgctggctccgagtgcgaggatgtggatgagtgtgagaaccacctcgcatgccctgggcaggagtgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagcc

SEQ ID NO: 147577 - DNA, 670 bp, Homo sapiens
  Payload ID: 9201
  Gene Symbol: LTBP4
  Gene Name: latent transforming growth factor beta binding protein 4
  ENST ID: ENST00000597071
  CDS Start-End: 1-670
caacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacct

SEQ ID NO: 147578 - DNA, 547 bp, Homo sapiens
  Payload ID: 9201
  Gene Symbol: LTBP4
  Gene Name: latent transforming growth factor beta binding protein 4
  ENST ID: ENST00000622457
  CDS Start-End: 1-547
atggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctgacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctg

SEQ ID NO: 147579 - DNA, 281 bp, Homo sapiens
  Payload ID: 9201
  Gene Symbol: LTBP4
  Gene Name: latent transforming growth factor beta binding protein 4
  ENST ID: ENST00000599225
  CDS Start-End: 1-281
cccgcttcgacatgccagactttgaggacgatggtggcccctatggcgaatctgaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattc

SEQ ID NO: 147580 - DNA, 755 bp, Homo sapiens
  Payload ID: 9201
  Gene Symbol: LTBP4
  Gene Name: latent transforming growth factor beta binding protein 4
  ENST ID: ENST00000612121
  CDS Start-End: 1-755
cttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagcc

SEQ ID NO: 147581 - DNA, 657 bp, Homo sapiens
  Payload ID: 9201
  Gene Symbol: LTBP4
  Gene Name: latent transforming growth factor beta binding protein 4
  ENST ID: ENST00000594537
  CDS Start-End: 5-217
ggagatgtctgcaagaacggcacctttctcctggtcaggcgggaaactgaggcccaaagaccaagaaacgctggcttctggacacacatcgtggaaggcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcac

SEQ ID NO: 147582 - DNA, 567 bp, Homo sapiens
  Payload ID: 9201
  Gene Symbol: LTBP4
  Gene Name: latent transforming growth factor beta binding protein 4
  ENST ID: ENST00000618486
  CDS Start-End: 1-567
acgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagcc

SEQ ID NO: 147583 - DNA, 699 bp, Homo sapiens
  Payload ID: 9201
  Gene Symbol: LTBP4
  Gene Name: latent transforming growth factor beta binding protein 4
  ENST ID: ENST00000598166
  CDS Start-End: 1-438
ccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgccttcagcagcgatcgttgtctcccctccgcagacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccaccta

SEQ ID NO: 147584 - DNA, 726 bp, Homo sapiens
  Payload ID: 9201
  Gene Symbol: LTBP4
  Gene Name: latent transforming growth factor beta binding protein 4
  ENST ID: ENST00000599016
  CDS Start-End: 12-146
gcccccagcaaatgctccagccacaggcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcaga

SEQ ID NO: 147585 - DNA, 723 bp, Homo sapiens
  Payload ID: 9201
  Gene Symbol: LTBP4
  Gene Name: latent transforming growth factor beta binding protein 4
  ENST ID: ENST00000600026
  CDS Start-End: 284-418
gtttctgacaaaaaggacctgaaaaatcactgattctagaataggggagtgtcaaggggagttcatacccatgaatctccaccggtaggaatatcttgcatgccaggatgtctggaatgctgagaattataggatacagaaaggaacctggattactaggaaatctagagaatgggagagatcctggactatccgcccttccagagcactggaaggtttgtttgcgttccaagaaatccataatggcaggagattccggattatcagagaatctggaacacaaatgggagacgtaaaagcgttgctgtttgtcgctgctgcccgggccagacgtctaggaggagccgctgcatccgagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccg

SEQ ID NO: 147586 - DNA, 1116 bp, Homo sapiens
  Payload ID: 9202
  Gene Symbol: LXN
  Gene Name: latexin
  Uniprot ID: Q9BS40
  ENST ID: ENST00000264265
  CDS Start-End: 216-884
agaagcagtcagcccagggctctcggatgcagggagcctgggcccaaacagcagcttccggagtcggaaggagctgaggaagaagactgactgaaggagcttgcgacttttccgcctcggcaaccggacccagcagcaagcaggacgggcggcgctctgctactggtcccgttaagccagagtagcccaagccctgaagtcactgctcatccggaatggaaatcccgccgaccaactacccagcctccagggcggccttggtggcacagaactacatcaactaccagcaggggaccccgcacagggtgtttgaggtgcagaaggtcaaacaagccagcatggaggatattccaggaagaggacataagtatcaccttaaatttgctgttgaagaaattatacaaaaacaagttaaggtgaactgcacagctgaagtactttacccttcaacgggacaagaaactgcaccagaagtcaacttcacatttgaaggagaaactggaaagaatccagatgaagaagacaacacattttatcaaagacttaagtccatgaaggaaccgctagaagcacaaaatattccagacaattttggaaatgtatctccagaaatgacgctcgttctacatttagcctgggttgcctgtggttatataatatggcaaaattctactgaagacacatggtataaaatggtaaaaattcaaactgtcaagcaagtgcaaagaaatgatgactttattgaattagactacaccattctacttcataatatagcatctcaggagattattccctggcaaatgcaagttctctggcatccacaatacggcactaaagtaaaacataatagccgtctgccaaaggaagtacaactggaataaacaaaaaccctaacactggaagtgtaaacatgtctattgatgtgtatgccaatttcactggcatctagcttatgaggccaaataatcccaaagtgtcactttatataaatgtcttgattacagtatagaactttatagagtccataatacaaagtatcactacataaaaatgtctttaaaacagtaatagtggtatgtatatccaaaataaaaagcttcaatttcagcctca

SEQ ID NO: 147587 - DNA, 749 bp, Homo sapiens
  Payload ID: 9202
  Gene Symbol: LXN
  Gene Name: latexin
  ENST ID: ENST00000482640
  CDS Start-End: 1-472
cacagctgaagtactttacccttcaacgggacaagaaactgcaccagaagtcaacttcacatttgaaggagaaactggaaagaatccagatgaagaagacaacacattttatcaaagacttaagtccatgaaggaaccgctagaagcacaaaatattccagacaattttggaaatgtatctccagaaatgacgctcgttctacatttagcctgggttgcctgtggttatataatatggcaaaattctactgaagacacatggtataaaatggtaaaaattcaaactgtcaagcaagtgcaaagaaatgatgactttattgaattagactacaccattctacttcataatatagcatctcagttccatggaatccatgacagcaccaactccatctttacctttcacctaaacacaagcacagcaattcagactttctctgtccctgcattccaagaaggaaagaaatcttaactgaaatggaaacagttgccaggtgcagtggctcatgcctataatcccagcactgtgggagactgaggcaggatgataatttgagcccaagagtttgagaccagcctgagcaacaaagtgagacctcttctataaaaaataaaaataaaaccagaacacagatacttaacttaagcaactttcagataagcctaactgtcaaaagtccgctgttaccattgttttaatctttcaggtttataagctttattaaataatagcaacaaaacaattaaaa

SEQ ID NO: 147588 - DNA, 2066 bp, Homo sapiens
  Payload ID: 9203
  Gene Symbol: LAYN
  Gene Name: layilin
  Uniprot ID: Q6UX15
  ENST ID: ENST00000375614
  CDS Start-End: 337-1461
aaacgcgggatctcccagggaagctcggagggggacagggagctggttcccctctgcgactcgcccctctctggctggccgagtgtctggcgccaacctcgctggaggaggctgtcgggggcgggccagccagcggggctgccctcctcgcagtgacgtcccagggggcggaggggcgaccgactgactccgcgccctcccccccgcctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttaggaactggtatgtggatgagccatcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggctggcctgtgcatcggcaattctcatatctgtttttttcaaagaataataaaatcaaataaagagcaggaaacagagtgttagtctgtgtctacagcccttcctctgcatgtggccacaggggacctttttttgtttctcctgacatccagacttggaaatatctaactacttgc

SEQ ID NO: 147589 - DNA, 1836 bp, Homo sapiens
  Payload ID: 9203
  Gene Symbol: LAYN
  Gene Name: layilin
  Uniprot ID: Q6UX15
  ENST ID: ENST00000375615
  CDS Start-End: 186-1334
agtgacgtcccagggggcggaggggcgaccgactgactccgcgccctcccccccgcctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgcctcggatttggacctcagaggagggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttaggaactggtatgtggatgagccatcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggctggcctgtgcatcggcaattctcatatctgtttttttcaaagaataataaaatcaaataaagagcaggaaa

SEQ ID NO: 147590 - DNA, 2590 bp, Homo sapiens
  Payload ID: 9203
  Gene Symbol: LAYN
  Gene Name: layilin
  Uniprot ID: Q6UX15
  ENST ID: ENST00000436913
  CDS Start-End: 614-1303
aaacgcgggatctcccagggaagctcggagggggacagggagctggttcccctctgcgactcgcccctctctggctggccgagtgtctggcgccaacctcgctggaggaggctgtcgggggcgggccagccagcggggctgccctcctcgcagtgacgtcccagggggcggaggggcgaccgactgactccgcgccctcccccccgcctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttagagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggctggcctgtgcatcggcaattctcatatctgtttttttcaaagaataataaaatcaaataaagagcaggaaacagagtgttagtctgtgtctacagcccttcctctgcatgtggccacaggggacctttttttgtttctcctgacatccagacttggaaatatctaactacttgcaaaactaaaaatgaggccaggcgcagtggctgacgcctgtaatcccagaaccttgggagaccaagattggaggatagcttgagttcaggagttccagaccttcctgggcaaaatagtgagactctgactctacaaaaaatttaaaaattagcagggcatggtggcatgcgcctgcagtcccagctactcaggaggccgaggtgggggaattgcttgagcccaggaggttgaggctgcagtgagctaggatcacgccactgctctcctgcgtgggcaacagaatgagaccctgtctctaaacaaaaatattttttaaagaaactaaaaatgaaatttgagtctcagcttctaggcttatgtactcccatccctgatactacacgttgttctgtttgcatgtttgttactgcagcatcaacataacatgactaataatgatgacagttctaccttttgttgacagacctcattgtttcaattgtgtttggcctcaaattcagagaaaagtttctcagcccagcatcaatcatatacacattggaggtctgaaagccattatttaaatcaccagcaatttccctcaatcagcttcataatctcatattttaacctttcctcatatgtcttattttttaatagctcagcaactttgcttcacatatggagccccaacctctagagt

SEQ ID NO: 147591 - DNA, 927 bp, Homo sapiens
  Payload ID: 9203
  Gene Symbol: LAYN
  Gene Name: layilin
  ENST ID: ENST00000530962
  CDS Start-End: 601-927
cgctccgggaggcggccgcagagacagcggggtagggatgctggatccccggtgccgtgggaaccctgcctgttactcctcgtctcttctgcggggttggatggctgggtcgagcgcccggtatgagagcgcttagagatcgggaaagaactccagttagtgtgggacgagccccacctgactccggggaatgactctctgcttccttcctcctgttgtgtcactgcagcctcggatttggacctcagaggagggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttaggaactggtatgtggatgagccatcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaa

SEQ ID NO: 147592 - DNA, 550 bp, Homo sapiens
  Payload ID: 9203
  Gene Symbol: LAYN
  Gene Name: layilin
  ENST ID: ENST00000533999
  CDS Start-End: 403-550
attccctgctcaggcgtcgcccttcgtgctgggactgcggcctgctgagccccagggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttaggaactggtatgtggatgagccatcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgagg

SEQ ID NO: 147593 - DNA, 2172 bp, Homo sapiens
  Payload ID: 9203
  Gene Symbol: LAYN
  Gene Name: layilin
  ENST ID: ENST00000525866
  CDS Start-End: 125-529
gtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttagagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaagaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggctggcctgtgcatcggcaattctcatatctgtttttttcaaagaataataaaatcaaataaagagcaggaaacagagtgttagtctgtgtctacagcccttcctctgcatgtggccacaggggacctttttttgtttctcctgacatccagacttggaaatatctaactacttgcaaaactaaaaatgaggccaggcgcagtggctgacgcctgtaatcccagaaccttgggagaccaagattggaggatagcttgagttcaggagttccagaccttcctgggcaaaatagtgagactctgactctacaaaaaatttaaaaattagcagggcatggtggcatgcgcctgcagtcccagctactcaggaggccgaggtgggggaattgcttgagcccaggaggttgaggctgcagtgagctaggatcacgccactgctctcctgcgtgggcaacagaatgagaccctgtctctaaacaaaaatattttttaaagaaactaaaaatgaaatttgagtctcagcttctaggcttatgtactcccatccctgatactacacgttgttctgtttgcatgtttgttactgcagcatcaacataacatgactaataatgatgacagttctaccttttgttgacagacctcattgtttc

SEQ ID NO: 147594 - DNA, 1763 bp, Homo sapiens
  Payload ID: 9203
  Gene Symbol: LAYN
  Gene Name: layilin
  ENST ID: ENST00000525126
  CDS Start-End: 136-948
ccccgcctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgcctcggatttggacctcagaggagggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttaggaactggtatgtggatgagccatcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaaggcaaaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggctggcctgtgcatcggcaattctcatatctgtttttttcaaagaa

SEQ ID NO: 147595 - DNA, 1703 bp, Homo sapiens
  Payload ID: 9203
  Gene Symbol: LAYN
  Gene Name: layilin
  ENST ID: ENST00000533265
  CDS Start-End: 115-903
tcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtgggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttaggaactggtatgtggatgagccatcctgcggcagcgaggtctgcgtggtcatgtaccatcagccatcggcacccgctggcatcggaggcccctacatgttccagtggaatgatgaccggtgcaacatgaagaacaatttcatttgcaaatattctgatgagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaaggcaaaaaacgggagcagccagaccctagcacaaagaagcaacacaccatctggccctctcctcaccagggaaacagcccggacctagaggtctacaatgtcataagaaaacaaagcgaagctgacttagctgagacccggccagacctgaagaatatttcattccgagtgtgttcgggagaagccactcccgatgacatgtcttgtgactatgacaacatggctgtgaacccatcagaaagtgggtttgtgactctggtgagcgtggagagtggatttgtgaccaatgacatttatgagttctccccagaccaaatggggaggagtaaggagtctggatgggtggaaaatgaaatatatggttattaggacatataaaaaactgaaactgacaacaatggaaaagaaatgataagcaaaatcctcttattttctataaggaaaatacacagaaggtctatgaacaagcttagatcaggtcctgtggatgagcatgtggtccccacgacctcctgttggacccccacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccacatatggtagcacaggctggcctgtgcatcggcaattctcatatct

SEQ ID NO: 147596 - DNA, 664 bp, Homo sapiens
  Payload ID: 9203
  Gene Symbol: LAYN
  Gene Name: layilin
  ENST ID: ENST00000528924
  CDS Start-End: 339-664
ggtcgagcgcccggtatgagagcgcttagagatcgggaaagaactccagttagtgtgggacgagccccacctgactccggggaatgactctctgcttccttcctcctgttgtgtcactgcagcctcggatttggacctcagaggagggcagccagtctgccggggagggacacagaggccttgttataaagtcatttacttccatgatacttctcgaagactgaactttgaggaagccaaagaagcctgcaggagggatggaggccagctagtcagcatcgagtctgaagatgaacagaaactgatagaaaagttcattgaaaacctcttgccatctgatggtgacttctggattgggctcaggaggcgtgaggagaaacaaagcaatagcacagcctgccaggacctttatgcttggactgatggcagcatatcacaatttagagaaaccagcagttccttctagagaagctgaaggtgaggaaacagagctgacaacacctgtacttccagaagaaacacaggaagaagatgccaaaaaaacatttaaagaaagtagagaagctgccttgaatctggcctacatcctaatccccagcattccccttctcctcctccttgtggtcaccacagttgtatgttgggtttggatctgtagaaaaag

SEQ ID NO: 147597 - DNA, 1320 bp, Homo sapiens
  Payload ID: 9204
  Gene Symbol: LBHD1
  Gene Name: LBH domain containing 1
  Uniprot ID: Q9BQE6
  ENST ID: ENST00000354588
  CDS Start-End: 217-1008
cagcattttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcactctga

SEQ ID NO: 147598 - DNA, 821 bp, Homo sapiens
  Payload ID: 9204
  Gene Symbol: LBHD1
  Gene Name: LBH domain containing 1
  ENST ID: ENST00000415855
  CDS Start-End: 28-821
gagatcagcattttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggagctgaagaagaagctgttcaaacgccggcgggtgttgaatcgggagcggcgtctgaggcaccgggtggtcggggctgtgatagacc

SEQ ID NO: 147599 - DNA, 2915 bp, Homo sapiens
  Payload ID: 9204
  Gene Symbol: LBHD1
  Gene Name: LBH domain containing 1
  Uniprot ID: Q9BQE6
  ENST ID: ENST00000431002
  CDS Start-End: 1735-2604
attttccgcaaggaatccatggccgcctgcacagccagcggagcgcccacgggagctccccgcagccgcaagctgttgccgcgcggtctcactaccccttggcgcaggctagagcgccctatagcagaaaccatagataagcggccggctagagaggacctgctcgaggaaacgtttggaatccggagcgcttggatctcaggtttagctgagggggttgaggtgtccaagaagtgctggcaccaagggctgagcgcggggaccctgtgtcctcaattccggggtgggattgctagggggagagtgcgtgtcttcatggttgccgtgggttttatgattgcccatttttctgtcttccgacgtttcccgatcagtagaggcccgagctgtgctctgtggtttcctgcagtcacccgcgcgttttcaacacagcgcatggagggcatctacacacatacacatccctctccatcccctcaactctggaacaaacactcaaagtcaagtatactggttggagaaatgggtaatagttacttatctttaacatttattttacaaacaacctattccttttctcgtcatggtacacacttggtattgtttgggtttttttttggttttgttgttgttgttagtgtgtgggcgtggttttgtttgtttttggagacaaggtctcgctctgtcgcccagggctggagtgcagtggcgcgatcatggctcactgaagcctcgacttccagggcccaagcgatcctcctgcctcaacctcccggatagctgggattacaggcgtgcaccaccacgcccggctggtattgctttttgttttgcttcgttttcttttttgctttttgagacagagtctcactctgttgcccagctggagtgcagtggcgtgatctcggctcactgcaagctctgcctcccgggttcacgccattctcctgcctcagcctcccgagtagctgggactacaggcgcccgccaccacggccggctaattttttgtatttttagtagagaaagagtttcactatgtaggtcaggctggtctcgaactcctgacctcgtgatccgcccaatccgcccacctcggcctcccaaagtgctgggattacaggtgtgagccaccgcgcccggctgttttgctttgttttcaaccactaaaaggctggattcgtgtaacatactgaattctgctttacagaagaaaacacctcttagctgtgtgactgattataggcaagttcttgtgccccggtttctgcatcagaaaatgaagcttataacaacagtacttgtctcacagttttaggataattaaattagttatatgtaaagcaattaaaacagctcctgccaaagagtaaacaccatataaatattcattaaataacatacaaacataccaggttgggaaaaatcagtaagcataggagtcaggaaattccaagttggttatcacaactcttggcccacagggctttaatccaggtgcccttgtctcctacccttgttgccatcccagtgtctccagggagtaagtagaaataaagatcctatctcacctcttgggcattttcccctcccctgaaagcgtataatcgcttagcacagtcggtgcttaaggggccaggctccaaagaagattaaaggaacagtttgtggggtgcactgggcagcagtactctcctctgagttcaatcatcttgcactctaagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggttagtacttcctcagcctgtgtctggcagctggcttaccctccagtttggcccaacctccctgctgtccctattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaactccatttgtaataaagccctagcactctg

SEQ ID NO: 147600 - DNA, 403 bp, Homo sapiens
  Payload ID: 9204
  Gene Symbol: LBHD1
  Gene Name: LBH domain containing 1
  ENST ID: ENST00000528862
  CDS Start-End: 37-403
ccgacggcagctcacaggaccccggagagtcctggcatggtatctcggtccggactctccgctgggcccacgaaggagaaaggctgcctcggattcctgcgcccaagccaaggtccggcgcccacggaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggaca

SEQ ID NO: 147601 - DNA, 1508 bp, Homo sapiens
  Payload ID: 9204
  Gene Symbol: LBHD1
  Gene Name: LBH domain containing 1
  Uniprot ID: Q9BQE6
  ENST ID: ENST00000532208
  CDS Start-End: 436-1227
tccaagaagtgctggcaccaagggctgagcgcggggaccctgtgtcctcaattccggggtgggattgctagggggagagtgcgtgtcttcatggttgccgtgggttttatgattgcccatttttctgtcttccgacgtttcccgatcagtagaggcccgagctgtgctctgtggtttcctgcagtcacccgcgcgttttcaacacagcgcatggagggcatctacacacatacacatccctctccatcccctcaactctggaacaaacactcaaagtcaagtatactggttggagaaatggcgtataatcgcttagcacagtcggtgcttaaggggccaggctccaaagaagattaaaggaacagtttgtggggtgcactgggcagcagtactctcctctgagttcaatcatcttgcactctaagaatcaccaccatggcccttgtgccagggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttcttccaagaccaaagtgaagagccaggctgggcttggagcccacaggaccctagaagtcctttaagaacatttaacgctggactcagctgggggcaggaccaggatgaagaagatgcttgttggattcttgaggacacagcatgtctggaagccaccaaccactgtcccttctgggactcaacaggctcccgtgtttgtagaagtggctttgtggaatattcccatctcctgcctcctaatagctttgagggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagattctcaactggagccagccttcagactcagtggttgtttcagaggactttgacaaaagcaaggccccttttcactctccagatttcctcctacctaatggcctactgacctcccctagagggatgtctttgggagggaagaaggtacagaagaaagattggagaagggcctctctagcagtcaa

SEQ ID NO: 147602 - DNA, 492 bp, Homo sapiens
  Payload ID: 9204
  Gene Symbol: LBHD1
  Gene Name: LBH domain containing 1
  ENST ID: ENST00000377954
  CDS Start-End: 129-492
atagataagcggccggctagagaggacctgctcgaggaaacgtttggaatccggagcgcttggatctcagaggcccgagctgtgctctgtggtttcctgcagtcacccgcgcgttttcaacacagcgcatggagggcatctacacacatacacatccctctccatcccctcaactctggaacaaacactcaaagtcaagtatactggttggagaaatggggagaagcaaggaggatgggctttggactagaaatagcccaggctcctcccagcatccagaaagtcccaggctgcccaaccctctctgggacagaggaaaaattggcaaggttgaaggtcaccagcacattcaggatttctctcaaaagtcccatctgccgtctattgtggtggaatccagtgaggtgaatgaagagagtggggatctccatttgccccatgaggagctgctgctgctcactgatggtgaggaagaggatgctgaggccttct

SEQ ID NO: 147603 - DNA, 1178 bp, Homo sapiens
  Payload ID: 9205
  Gene Symbol: LIME1
  Gene Name: Lck interacting transmembrane adaptor 1
  Uniprot ID: Q9H400
  ENST ID: ENST00000309546
  CDS Start-End: 88-975
agccgagggctgcacaaagaccttcctggcctgccccagacagagctgaggacccctggccgtgggcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggctgccagcccgtgaggtccgtgaggtcctggccgctctgacagccgcggcctccccgggctccagagaaggcccgcgtctaaataaagcgccagcgcaggatgaaagcg

SEQ ID NO: 147604 - DNA, 451 bp, Homo sapiens
  Payload ID: 9205
  Gene Symbol: LIME1
  Gene Name: Lck interacting transmembrane adaptor 1
  ENST ID: ENST00000444951
  CDS Start-End: 132-451
aggccagggtgcccgccaggctgcctgacacccacagatgggtggagctcagtgctgctccagcgggcgagacgggcgggagaggactgtggcccaccacgtggggcactcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtc

SEQ ID NO: 147605 - DNA, 661 bp, Homo sapiens
  Payload ID: 9205
  Gene Symbol: LIME1
  Gene Name: Lck interacting transmembrane adaptor 1
  ENST ID: ENST00000493265
  CDS Start-End: 267-661
ccgtggtcacccgcagggacacggaggggccaggcagagcagccctagttcacctcaccgggagcccccgccagaaggtgggcacctctgggagggagggactgccaggccttggggcttcctgtgctgagtcagagctggaacgggagacgcaggagccccgcagccgcgggaggtgcagatttggggctgccaggtggcgccaggtccccttggccagcccccagcgcccctttcttctgtccccagggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggcca

SEQ ID NO: 147606 - DNA, 819 bp, Homo sapiens
  Payload ID: 9205
  Gene Symbol: LIME1
  Gene Name: Lck interacting transmembrane adaptor 1
  ENST ID: ENST00000480139
  CDS Start-End: 62-592
tggcctgccccagacagagctgaggacccctggccgtgggcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcgcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctg

SEQ ID NO: 147607 - DNA, 809 bp, Homo sapiens
  Payload ID: 9205
  Gene Symbol: LIME1
  Gene Name: Lck interacting transmembrane adaptor 1
  ENST ID: ENST00000476183
  CDS Start-End: 52-809
gccagcccccagcgcccctttcttctgtccccagggcctcggcttcacaggatggggctgccagtgtcctgggcccctcctgccctctgggttctagggtgctgcgccctgctcctctcgctgtgggcgctgtgcacagcctgccgcaggaagagggcgcggaggcagcgggcgaggctgcagggcagtgcgacggcggcggaagcgtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctggg

SEQ ID NO: 147608 - DNA, 805 bp, Homo sapiens
  Payload ID: 9205
  Gene Symbol: LIME1
  Gene Name: Lck interacting transmembrane adaptor 1
  ENST ID: ENST00000487026
  CDS Start-End: 74-709
caaagaccttcctggcctgccccagacagagctgaggacccctggccgtgggcttgggcctcggcttcacaggatggggctgccagtgtcctgggcccctcctgccctctgggttctagggtgctgcgccctgctcctctcgctgtgggcgctgtgcacagcctgccgcaggcccgaggacgctgtagcccccaggaagagggcgcggaggcagcgggcgaggctgcagggcagtgcgacggcggcggaagcggtgagtgccaggctgtcccggggaccagggtggggtccgcagggcaccgaccagccttcctcgcccccagtccctactgaggcggacccacctctgctccctcagcaagtcggacaccagactgcacgagctgcaccggggcccgcgcagcagcagggccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtggacgtcctgtactccagggtctgcaagcctaaaaggagggacccaggacccaccacagacccgctggaccccaa

SEQ ID NO: 147609 - DNA, 2166 bp, Homo sapiens
  Payload ID: 9206
  Gene Symbol: LCK
  Gene Name: LCK proto-oncogene, Src family tyrosine kinase
  Uniprot ID: P06239
  ENST ID: ENST00000333070
  CDS Start-End: 101-1720
gagggctcagagggagcaccggtttggagctgggaccccctattttagcttttctgtggctggtgaatggggatcccaggatctcacaatctcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgacacacttctagactcccagttggaggagaaaggtctgggggcctccccctggggcaacttgggccagcaactcttgcttctgcccacagggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgtt

SEQ ID NO: 147610 - DNA, 2117 bp, Homo sapiens
  Payload ID: 9206
  Gene Symbol: LCK
  Gene Name: LCK proto-oncogene, Src family tyrosine kinase
  Uniprot ID: P06239
  ENST ID: ENST00000336890
  CDS Start-End: 139-1668
aagtcagggtgggacgtgggcgcggggagacaggtggtggctacgacggcgaagggagctgagactgtccaggcagccaggttaggccaggaggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgta

SEQ ID NO: 147611 - DNA, 932 bp, Homo sapiens
  Payload ID: 9206
  Gene Symbol: LCK
  Gene Name: LCK proto-oncogene, Src family tyrosine kinase
  ENST ID: ENST00000373557
  CDS Start-End: 78-932
acttgtagcctgagggctcagagggagcaccggtttggagctgggaccccctattttagcttttctgtggctggtgaatggggatcccaggatctcacaatctcaggtacttttggaactttccagggcaaggccccattatatctgatgttgggggagcagatcttgggggagccccttcagccccctcttccattccctcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttccc

SEQ ID NO: 147612 - DNA, 551 bp, Homo sapiens
  Payload ID: 9206
  Gene Symbol: LCK
  Gene Name: LCK proto-oncogene, Src family tyrosine kinase
  ENST ID: ENST00000373562
  CDS Start-End: 139-551
gaatttacttgtagcctgagggctcagagggagcaccggtttggagctgggaccccctattttagcttttctgtggctggtgaatggggatcccaggatctcacaatctcagccccctcttccattccctcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcgga

SEQ ID NO: 147613 - DNA, 2137 bp, Homo sapiens
  Payload ID: 9206
  Gene Symbol: LCK
  Gene Name: LCK proto-oncogene, Src family tyrosine kinase
  ENST ID: ENST00000373564
  CDS Start-End: 139-1689
aagtcagggtgggacgtgggcgcggggagacaggtggtggctacgacggcgaagggagctgagactgtccaggcagccaggttaggccaggaggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaaggtgaccccaggcagcagggcctgaaagacaaggcctgcggatccctggctgttggcttccacctctcccccacctactttctccccggtcttgccttccttgtcccccaccctgtaactccaggcttcctgccgatcccagctcggttctccctgatgccccttgtctttacagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgt

SEQ ID NO: 147614 - DNA, 714 bp, Homo sapiens
  Payload ID: 9206
  Gene Symbol: LCK
  Gene Name: LCK proto-oncogene, Src family tyrosine kinase
  ENST ID: ENST00000482949
  CDS Start-End: 114-714
ggagacaggtggtggctacgacggcgaagggagctgagactgtccaggcagccaggttaggccaggaggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaaggtgaccccaggcagcagggcctgaaagacaaggcctgcggatccctggctgttggcttccacctctcccccacctactttctccccggtcttgccttccttgtcccccaccctgtaactccaggcttcctgccgatcccagctcggttctccctgatgccccttgtctttacagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctgg

SEQ ID NO: 147615 - DNA, 566 bp, Homo sapiens
  Payload ID: 9206
  Gene Symbol: LCK
  Gene Name: LCK proto-oncogene, Src family tyrosine kinase
  ENST ID: ENST00000461712
  CDS Start-End: 120-566
gtgaatttacttgtagcctgagggctcagagggagcaccggtttggagctgggaccccctattttagcttttctgtggctggtgaatggggatcccaggatctcacaatctcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaaggtgaccccaggcagcagggcctgaaagacaaggcctgcggatccctggctgttggcttccacctctcccccacctactttctccccggtcttgccttccttgtcccccaccctgtaactccaggcttcctgccgatcccagctcggttctccctgatgccccttgtctttacagacaacctggttatcgctctgcacagctatgagccctctcacgacggagatctgggctttgagaagggggaacagctccgcatcctg

SEQ ID NO: 147616 - DNA, 1060 bp, Homo sapiens
  Payload ID: 9206
  Gene Symbol: LCK
  Gene Name: LCK proto-oncogene, Src family tyrosine kinase
  ENST ID: ENST00000495610
  CDS Start-End: 104-1060
ggtggctacgacggcgaagggagctgagactgtccaggcagccaggttaggccaggaggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacatt

SEQ ID NO: 147617 - DNA, 580 bp, Homo sapiens
  Payload ID: 9206
  Gene Symbol: LCK
  Gene Name: LCK proto-oncogene, Src family tyrosine kinase
  ENST ID: ENST00000477031
  CDS Start-End: 78-580
acttgtagcctgagggctcagagggagcaccggtttggagctgggaccccctattttagcttttctgtggctggtgaatggggatcccaggatctcacaatctcaggtacttttggaactttccagggcaaggccccattatatctgatgttgggggagcagatcttgggggagccccttcagccccctcttccattccctcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaaggtgaccccaggcagcagggcctgaaagacaaggcctgcggatccctggctgttggcttccacctctcccccacctactttctccccggtcttgccttccttgtcccccaccctgtaactccaggcttcctgccgatcccagctcggttctccctgatgccccttgtctttacagacaacctggt

SEQ ID NO: 147618 - DNA, 2099 bp, Homo sapiens
  Payload ID: 9206
  Gene Symbol: LCK
  Gene Name: LCK proto-oncogene, Src family tyrosine kinase
  Uniprot ID: P06239
  ENST ID: ENST00000619559
  CDS Start-End: 122-1651
gtgtgaatttacttgtagcctgagggctcagagggagcaccggtttggagctgggaccccctattttagcttttctgtggctggtgaatggggatcccaggatctcacaatctcagggaccatgggctgtggctgcagctcacacccggaagatgactggatggaaaacatcgatgtgtgtgagaactgccattatcccatagtcccactggatggcaagggcacgctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaacagctccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgcgggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgt

SEQ ID NO: 147619 - DNA, 4542 bp, Homo sapiens
  Payload ID: 9207
  Gene Symbol: LCA5
  Gene Name: Leber congenital amaurosis 5
  Uniprot ID: Q86VQ0
  ENST ID: ENST00000369846
  CDS Start-End: 436-2529
accctggagcccaggttaccgccgctgccacccaggagccccgatcctcgcctctgtcccatccttgtgttcaaacctcccgcatctcggcaacctcggcacccgcccggcagcctccgcaggaaccaggcacccgctctttggcggtcagacgccgaggccccagctgggagtttggtcctaagagggaaggcaaggaggcgggacgccgcatcggctctgctgaagagcctgcgggttggagggcaaaaaagtttatcttctggatgccaatgtgaattgtggtctacaaatacattgtggagaaaatagattgcacagaaatgaatattatcaggatctgaagactgtgaaaatgtttttcagtattgtcatagtctcctctggagaaaataatctgtgaaattatgtgaatagagaccatttttcaaaacaatgggggaaagagcaggaagtccaggtactgatcaagaaagaaaggcaggcaaacaccattattcttacttatctgattttgaaacgccacagtcttctggccgatcatcgctggtcagttcttcacctgcaagtgttaggagaaaaaatcctaaaagacaaacttcagatggccaagtacatcaccaagcccctcggaaaccaagccctaagggtctaccaaacagaaagggagtccgagtgggatttcgctcccagagcctcaatagagagccacttcggaaagatactgatcttgttacaaaacggattctgtctgcaagactgctaaaaatcaatgagttgcagaatgaagtatctgaactccaggtcaagttagctgagctgctaaaagaaaataaatctttgaaaaggcttcagtacagacaggagaaagccctgaataagtttgaagatgccgaaaatgaaatctcacaacttatatttcgtcataacaatgagattacagcactcaaagaacgcttaagaaaatctcaagagaaagaacgggcaactgagaaaagggtaaaagatacagaaagtgaactatttaggacaaaattttccttacagaaactgaaagagatctctgaagctagacacctacctgaacgagatgatttggcaaagaaactagtttcagcagagttaaagttagatgacaccgagagaagaattaaggagctatcgaaaaaccttgaactgagtactaacagtttccaacgacagttgcttgctgaaaggaaaagggcatatgaggctcatgatgaaaataaagttcttcaaaaggaggtacagcgactatatcacaaattaaaggaaaaggagagagaactggatataaaaaatatatattctaatcgtctgccaaagtcctctccaaataaagagaaagaacttgcattaagaaaaaatgctgcatgccagagtgattttgcagacctgtgtacaaaaggagtacaaaccatggaagacttcaagccagaagaatatcctttaactccagaaacaattatgtgttacgaaaacaaatgggaagaaccaggacatcttactttggacttgcaatctcaaaagcaagacaggcatggagaagcagggattctaaacccaattatggaaagagaagaaaaatttgttacagatgaagaactccatgtcgtaaaacaggaggttgaaaagctggaggatgaatgggaaagagaagaacttgataaaaagcaaaaagaaaaggcatctttactggaaagagaagaaaagccagagtgggaaactggaaggtaccaactaggaatgtatccaattcagaatatggataaattgcaaggagaggaagaagaaagactgaagagagaaatgctacttgctaaactgaatgaaattgacagagaactccaagattctcgaaatctaaaataccctgttttgccattgttacctgattttgaatcaaaactacactccccagagagaagccccaaaacatacaggttctctgaatcctcagagagattatttaatgggcatcatttgcaagacatcagtttctcaactccaaaaggagaaggtcagaattcaggaaatgttagaagtccagcctcccctaatgagttcgcatttggtagctacgtgccttcgtttgcaaaaacatcagagaggtcaaatccatttagtcaaaaaagtagttttttggatttccaaagaaacagtatggaaaaacttagtaaagatggtgtagatttaattacaagaaaagagaaaaaagctaatttgatggaacagttatttggtgccagtggtagcagcaccatttcctccaaaagcagtgacccaaattctgtggcttccagtaaaggagacattgaccctctaaattttctccctgggaataaaggcagcagagatcaagaacatgatgaagatgaaggctttttcctcagtgaaggaagaagttttaatccaaataggcaccgattaaaacatgcagacgataaaccagcagtaaaagcagctgattctgtagaagatgaaattgaagaagtagcactgagatgactgactagagtatacattttttctaattgtaaatattgaaatattttaatacagtatttattataaacatttagactttttaatgctaaaatgtccttattaaggaatgatttttaatagctaaatacaatgcagttaaaaagaagtagatcatacatacaccacatagatagtttgccaagaatgaaggaggcttttttgaatgaaaccaaaaataaaaatatgtcttgaaaaatgaaatagattttaactcttcatccagtgctatggcaagtttaactgcactggaggtggtattccttttctacttttattcctatttatgtatttatttttaatcatattctcactgtgctaaatacagtcttcccactaattgttgaatgaaaattaagggtgaaagtctgtgttgggaagtgtagctccggatggtggagaaccagtgcttcttaggagcccttccctttatggatagggccaggggtccctatcttacgtggcagtcctaagctactcttgagtgatagcagtcacaacattgggatttcccattcctctgaaagtacccacagctaaacactactcatttcccaatttcagtatttactgaaatcacttacctacaattctgttagaatattatgttgagttcggaagacatttctctgtttgcaaggacagttagttgctctctgtcatagcccgcagaagcttggctacagtgtaattcctctccttgttctcctacactctttgtatctcagtgactgggtgtaagatttcatgccaaatgcaaggaatagtggaaatacataccaactgcaaagaatagaaaaactttatcccaatatattatagaaagatcttcagttcaattatgtccagagtaatataatttggcaatgttaatgcttttaagatttgaacttgtcctcaaaccaaggagacaacaatagtgtaatactattggacttacaggattagttttaaagcaactttgaatagaagtgtttcagacataggacttctgccttgttgactagagtggatagttttctgtttaaatgcattggtcttttggctgtttgtaattcacttcagcttatagagaagttgatgaccttggatcatgctgggtatgattggtctttaaaaagcagtaatataccaccagcccaaggagaaaacattgttaaaatgaagagtggtggaaatagtgtgttgggaagaataaaaaatttagattggcacttattctaaagtgagctgtttttttcaagaatttactagcatttgctcgtagtatgatttctgacgccagtcatatatactgatgaggggaaggagttactgtgttattctgagttcttataaatgcatattattgaatttcattgcatgactatttgtcaagacttacctggttaggtctccaattaaaagatgtaccacctgtcatcttctaaattgtgttcctttcatttattgggaacagaatctctcaaaagtgctaaactatattaaaaagttttcttaatagatttgtatgtctgatatgtataaccatttactataatatgttgcaaatcattctaatatatgtaaaacaatattatttgtaatgcagttattggtaaaatattatgtaatgttaattttgttcctagctgctaatttttctgccaaaagtattctaattttcaggttgttttaaaggcttttaaaactttttagttaagttttttattcacgtcatttaaattagttttttgctttttttctacctgataatctctttaacaagatgcaacaagacagaattattaaaattaaacctaaagttaagttacagatttaaaggcattatgatattaagcattaaaattggagattaaaatgtacaaaacagggttttccttatgaacaaaccttacagggtaaattgtttttttttctaaatgtcattaaatttatttgtactcagaactgttactaataaaaattaaaaatgca

SEQ ID NO: 147620 - DNA, 4719 bp, Homo sapiens
  Payload ID: 9207
  Gene Symbol: LCA5
  Gene Name: Leber congenital amaurosis 5
  Uniprot ID: Q86VQ0
  ENST ID: ENST00000392959
  CDS Start-End: 613-2706
agtctaggcctccgcctccgttaccctggagcccaggttaccgccgctgccacccaggagccccgatcctcgcctctgtcccatccttgtgttcaaacctcccgcatctcggcaacctcggcacccgcccggcagcctccgcaggaaccaggcacccgctctttggcggtcagacgccgaggccccagctgggagtttggtcctaagagggaaggcaaggaggcgggacgccgcatcggctctgctgaagagcctgcgggttggaggtgggctttgaagtgggcgtggagacggcgggggaggtggaggtgcgagtataaatgatcaaccagaaattatcttcaaaggaataaaaccagaagtatgtaaataaaaagcccaagataaagaaacagaaaagctgacactacatgaagcagagggcaaaaaagtttatcttctggatgccaatgtgaattgtggtctacaaatacattgtggagaaaatagattgcacagaaatgaatattatcaggatctgaagactgtgaaaatgtttttcagtattgtcatagtctcctctggagaaaataatctgtgaaattatgtgaatagagaccatttttcaaaacaatgggggaaagagcaggaagtccaggtactgatcaagaaagaaaggcaggcaaacaccattattcttacttatctgattttgaaacgccacagtcttctggccgatcatcgctggtcagttcttcacctgcaagtgttaggagaaaaaatcctaaaagacaaacttcagatggccaagtacatcaccaagcccctcggaaaccaagccctaagggtctaccaaacagaaagggagtccgagtgggatttcgctcccagagcctcaatagagagccacttcggaaagatactgatcttgttacaaaacggattctgtctgcaagactgctaaaaatcaatgagttgcagaatgaagtatctgaactccaggtcaagttagctgagctgctaaaagaaaataaatctttgaaaaggcttcagtacagacaggagaaagccctgaataagtttgaagatgccgaaaatgaaatctcacaacttatatttcgtcataacaatgagattacagcactcaaagaacgcttaagaaaatctcaagagaaagaacgggcaactgagaaaagggtaaaagatacagaaagtgaactatttaggacaaaattttccttacagaaactgaaagagatctctgaagctagacacctacctgaacgagatgatttggcaaagaaactagtttcagcagagttaaagttagatgacaccgagagaagaattaaggagctatcgaaaaaccttgaactgagtactaacagtttccaacgacagttgcttgctgaaaggaaaagggcatatgaggctcatgatgaaaataaagttcttcaaaaggaggtacagcgactatatcacaaattaaaggaaaaggagagagaactggatataaaaaatatatattctaatcgtctgccaaagtcctctccaaataaagagaaagaacttgcattaagaaaaaatgctgcatgccagagtgattttgcagacctgtgtacaaaaggagtacaaaccatggaagacttcaagccagaagaatatcctttaactccagaaacaattatgtgttacgaaaacaaatgggaagaaccaggacatcttactttggacttgcaatctcaaaagcaagacaggcatggagaagcagggattctaaacccaattatggaaagagaagaaaaatttgttacagatgaagaactccatgtcgtaaaacaggaggttgaaaagctggaggatgaatgggaaagagaagaacttgataaaaagcaaaaagaaaaggcatctttactggaaagagaagaaaagccagagtgggaaactggaaggtaccaactaggaatgtatccaattcagaatatggataaattgcaaggagaggaagaagaaagactgaagagagaaatgctacttgctaaactgaatgaaattgacagagaactccaagattctcgaaatctaaaataccctgttttgccattgttacctgattttgaatcaaaactacactccccagagagaagccccaaaacatacaggttctctgaatcctcagagagattatttaatgggcatcatttgcaagacatcagtttctcaactccaaaaggagaaggtcagaattcaggaaatgttagaagtccagcctcccctaatgagttcgcatttggtagctacgtgccttcgtttgcaaaaacatcagagaggtcaaatccatttagtcaaaaaagtagttttttggatttccaaagaaacagtatggaaaaacttagtaaagatggtgtagatttaattacaagaaaagagaaaaaagctaatttgatggaacagttatttggtgccagtggtagcagcaccatttcctccaaaagcagtgacccaaattctgtggcttccagtaaaggagacattgaccctctaaattttctccctgggaataaaggcagcagagatcaagaacatgatgaagatgaaggctttttcctcagtgaaggaagaagttttaatccaaataggcaccgattaaaacatgcagacgataaaccagcagtaaaagcagctgattctgtagaagatgaaattgaagaagtagcactgagatgactgactagagtatacattttttctaattgtaaatattgaaatattttaatacagtatttattataaacatttagactttttaatgctaaaatgtccttattaaggaatgatttttaatagctaaatacaatgcagttaaaaagaagtagatcatacatacaccacatagatagtttgccaagaatgaaggaggcttttttgaatgaaaccaaaaataaaaatatgtcttgaaaaatgaaatagattttaactcttcatccagtgctatggcaagtttaactgcactggaggtggtattccttttctacttttattcctatttatgtatttatttttaatcatattctcactgtgctaaatacagtcttcccactaattgttgaatgaaaattaagggtgaaagtctgtgttgggaagtgtagctccggatggtggagaaccagtgcttcttaggagcccttccctttatggatagggccaggggtccctatcttacgtggcagtcctaagctactcttgagtgatagcagtcacaacattgggatttcccattcctctgaaagtacccacagctaaacactactcatttcccaatttcagtatttactgaaatcacttacctacaattctgttagaatattatgttgagttcggaagacatttctctgtttgcaaggacagttagttgctctctgtcatagcccgcagaagcttggctacagtgtaattcctctccttgttctcctacactctttgtatctcagtgactgggtgtaagatttcatgccaaatgcaaggaatagtggaaatacataccaactgcaaagaatagaaaaactttatcccaatatattatagaaagatcttcagttcaattatgtccagagtaatataatttggcaatgttaatgcttttaagatttgaacttgtcctcaaaccaaggagacaacaatagtgtaatactattggacttacaggattagttttaaagcaactttgaatagaagtgtttcagacataggacttctgccttgttgactagagtggatagttttctgtttaaatgcattggtcttttggctgtttgtaattcacttcagcttatagagaagttgatgaccttggatcatgctgggtatgattggtctttaaaaagcagtaatataccaccagcccaaggagaaaacattgttaaaatgaagagtggtggaaatagtgtgttgggaagaataaaaaatttagattggcacttattctaaagtgagctgtttttttcaagaatttactagcatttgctcgtagtatgatttctgacgccagtcatatatactgatgaggggaaggagttactgtgttattctgagttcttataaatgcatattattgaatttcattgcatgactatttgtcaagacttacctggttaggtctccaattaaaagatgtaccacctgtcatcttctaaattgtgttcctttcatttattgggaacagaatctctcaaaagtgctaaactatattaaaaagttttcttaatagatttgtatgtctgatatgtataaccatttactataatatgttgcaaatcattctaatatatgtaaaacaatattatttgtaatgcagttattggtaaaatattatgtaatgttaattttgttcctagctgctaatttttctgccaaaagtattctaattttcaggttgttttaaaggcttttaaaactttttagttaagttttttattcacgtcatttaaattagttttttgctttttttctacctgataatctctttaacaagatgcaacaagacagaattattaaaattaaacctaaagttaagttacagatttaaaggcattatgatattaagcattaaaattggagattaaaatgtacaaaacagggttttccttatgaacaaaccttacagggtaaattgtttttttttctaaatgtcattaaatttatttgtactcagaactgttactaataaaaattaaaaatgca

SEQ ID NO: 147621 - DNA, 2894 bp, Homo sapiens
  Payload ID: 9207
  Gene Symbol: LCA5
  Gene Name: Leber congenital amaurosis 5
  ENST ID: ENST00000467898
  CDS Start-End: 408-1700
atgattggctgcggtctcttcgtagtgcagtctaggcctccgcctccgttaccctggagcccaggttaccgccgctgccacccaggagccccgatcctcgcctctgtcccatccttgtgttcaaacctcccgcatctcggcaacctcggcacccgcccggcagcctccgcaggaaccaggcacccgctctttggcggtcagacgccgaggccccagggcaaaaaagtttatcttctggatgccaatgtgaattgtggtctacaaatacattgtggagaaaatagattgcacagaaatgaatattatcaggatctgaagactgtgaaaatgtttttcagtattgtcatagtctcctctggagaaaataatctgtgaaattatgtgaatagagaccatttttcaaaacaatgggggaaagagcaggaagtccaggtactgatcaagaaagaaaggcaggcaaacaccattattcttacttatctgattttgaaacgccacagtcttctggccgatcatcgctggtcagttcttcacctgcaagtgttaggagaaaaaatcctaaaagacaaacttcagatggccaagtacatcaccaagcccctcggaaaccaagccctaagggtctaccaaacagaaagggagtccgagtgggatttcgctcccagagcctcaatagagagccacttcggaaagatactgatcttgttacaaaacggattctgtctgcaagactgctaaaaatcaatgagttgcagaatgaagtatctgaactccaggtcaagttagctgagctgctaaaagaaaataaatctttgaaaaggcttcagtacagacaggagaaagccctgaataagtttgaagatgccgaaaatgaaatctcacaacttatatttcgtcataacaatgagattacagcactcaaagaacgcttaagaaaatctcaagagaaagaacgggcaactgagaaaagggtaaaagatacagaaagtgaactatttaggacaaaattttccttacagaaactgaaagagatctctgaagctagacacctacctgaacgagatgatttggcaaagaaactagtttcagcagagttaaagttagatgacaccgagagaagaattaaggagctatcgaaaaaccttgaactgagtactaacagtttccaacgacagttgcttgctgaaaggaaaagggcatatgaggctcatgatgaaaataaagttcttcaaaaggaggtacagcgactatatcacaaattaaaggaaaaggagagagaactggatataaaaaatatatattctaatcgtctgccaaagtcctctccaaataaagagaaagaacttgcattaagaaaaaatgctgcatgccagagtgattttgcagacctgtgtacaaaaggagtacaaaccatggaagacttcaagccagaagaatatcctttaactccagaaacaattatgtgttacgaaaacaaatgggaagaaccaggacatcttactttggacttgcaatctcaaaagcaagacaggcatggagaagcagggattctaaacccaattatggaaagagaagaaaaatttgttacagatgaagaactccatgtcgtaaaacaggaggttgaaaagctggaggatggtaagaaaaagagtttgtttaagcatgtgacaagtcagcatcccttgagaaagaaagagtgagcgtcttctaatatcttccagcttaactgtgaattgcttaggtagaacaaagaaaggtggatacagtggtaggggatggcttatcaggagccatacacatttgaataatgttattaaggaaagaaaaaaattgaacactctaagtcatttgctatttagggttagggaataaggacaagttgcattcagaaaattctgatgaagtagaattcagatgccacttactaaagttactatacttgtggtgttcttacatattttaaaatttttaattttttcatttggaagtagtttcaaagttaaagtggcaagaatagctaaagaactatttgtgagtgagttgtgtcatgcccatacctttaaatagttgtatgtatatttccccaaactaggacattctcttagactgtattctaatgtagttttcaacttcaggaaatttaactttgacacaacacatttatctgatctgtcattcatattatgattttgtcagttgatacaatattgttcttgatagaattttcttccctctggtacaagatcatgaattgcatttagttttcatatctcttcagtcttctttaatctagagatttttgttacatatatatatagagagagagagagggaaggaaaaagagaatgtgtgtgagagattaacatttttgatgaatatagacccatttttaaaaatagaatgttcttcattttgggtttgtctgaagttttctcttaattagattcaagttaatgcatcttctgtcagaataccacataagtctatctcaggatatgacattgaaaggtttcatttatttttaagtgtagagtctttgctccatctatccatccatccatccccaccatacagcattatattagttataaaaaataggcaaagaacctttcttccccaccagtatctcaaagaacaaatttttttataaatgagaatcttaaatgcaatacgtattaaatatattattctctaatcccagaatatcaagtatagaaatgaaatttatgatgtcttttctcacttgatttataatacccaaattaaatatggtggttttatgaaagttgatagttttcctatttaaaaatattgactgttacaaaatcccatttaaaaaatttgatttcatacagaatgggaaagagaagaacttgataaaaagcaaaaagaaa

SEQ ID NO: 147622 - DNA, 2416 bp, Homo sapiens
  Payload ID: 9208
  Gene Symbol: LCA5L
  Gene Name: Leber congenital amaurosis 5-like
  Uniprot ID: O95447
  ENST ID: ENST00000288350
  CDS Start-End: 366-2378
gggacgcgccggcgctgcggcgttggcgcagtcgtgggaacagcgcggagcagagaagcaccaaaagaggcaaactgagatgcagacaaatgatcatccgtatgctgatcattttgaatagttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaaaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtcacctacagaaggaaaaagaaaaataattatttaaatataatcaatatcctaatgcattctggtttgatataa

SEQ ID NO: 147623 - DNA, 2564 bp, Homo sapiens
  Payload ID: 9208
  Gene Symbol: LCA5L
  Gene Name: Leber congenital amaurosis 5-like
  Uniprot ID: O95447
  ENST ID: ENST00000358268
  CDS Start-End: 530-2542
gcggagcaggtaacggccccgctgctgccgtcgtccccctcagccggttaccctgttacagccccagctctgggcccttccggaccctcctgctacgctctttctgggcttccagtatcgccggtcactcagtcctcgcccctgcctgcctcgctggcgccccgccgtttcctcctcgcggcacagtttgccaaggaacagctaccccggctcggcagtgaccgggcgccccggcgacacacgtactctcaggcccgctgggcagggggacggcctgggccgaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaaaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtcacctacagaaggaaaaagaaaaataattatttaaatataatcaatatcctaatgca

SEQ ID NO: 147624 - DNA, 2080 bp, Homo sapiens
  Payload ID: 9208
  Gene Symbol: LCA5L
  Gene Name: Leber congenital amaurosis 5-like
  Uniprot ID: O95447
  ENST ID: ENST00000380671
  CDS Start-End: 30-2042
tttacttttcttttattaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaaaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacagagcttggaaaaacaactgaggttgaactgcagagcctttagccggcagctggctattgagactcggaagactttagcagctcagacagctaccaagactctgcaggtggaagtaaaacaccttcaacaaaaacttaaggaaaaggatcgtgagcttgaaattaaaaacatctatagtcatcgaatacttaaaaatttacatgacacagaggactatccaaaagtttcttcaacaaaatcagtccaagcagacagaaaaattttgccattcacaagtatgagacaccagggaacccaaaaatcagatgttccacctttgacaactaagggtaaaaaggcaacaggaaacatcgatcataaagaaaaatcaactgaaataaatcatgaaattcctcactgtgtgaataaactaccaaagcaagaggattctaagagaaaatatgaagatttatcaggggaagagaaacatttggaagtccaaatactgctggagaatactggaagacaaaaagacaaaaaagaagaccaagaaaagaaaaacatttttgtgaaagaagagcaagaactaccaccaaaaataattgaagttattcatcctgaaagagaaagcaatcaagaagatgttctagtaagagaaaagtttaaaagaagcatgcagagaaatggtgtggatgacacacttggcaaaggcactgctccctacacgaaaggccccctcagacaaagaagacattactcattcacagaagcaactgaaaacctgcatcatgggcttcctgcttcaggggggccagccaatgccggcaacatgaggtacagtcatagtacaggcaagcatctcagtaacagagaggaaatggagctagagcattctgacagtgggtatgagccctcatttggtaagtcttccagaataaaagtgaaggatacaactttcagagataagaaaagcagtctcatggaagaactctttggatcaggctatgtcttgaaaactgaccaatcaagtcctggtgttgcaaaaggctcagaggagcctttgcaaagtaaggagtcgcatcccctgcctcccagtcaggcctccaccagccatgctttcggagactctaaagtaactgtggtaaattctattaagccatcgtcacctacagaaggaaaaagaaaaataattatttaaatataatcaatatcctaatgcattctggtttgatataa

SEQ ID NO: 147625 - DNA, 706 bp, Homo sapiens
  Payload ID: 9208
  Gene Symbol: LCA5L
  Gene Name: Leber congenital amaurosis 5-like
  ENST ID: ENST00000415863
  CDS Start-End: 498-706
ccggcgctgcggcgttggcgcagtcgtgggaacagcgcggagcagagaagcaccaaaagaggcaaactgagatgcagacaaatgatcatccgtatgctgatcattttgaataccttcagccatgcttctgccactgcctctgcaggaaagccacctgctttaaaaaaaagtcttcatggagtgcttatgagagggtcggctgttttctccagctcatttttccaaagcaaacaatcccaccagctatctcaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaaga

SEQ ID NO: 147626 - DNA, 523 bp, Homo sapiens
  Payload ID: 9208
  Gene Symbol: LCA5L
  Gene Name: Leber congenital amaurosis 5-like
  ENST ID: ENST00000434281
  CDS Start-End: 238-523
ggaggccccgcgcgcgggtttccatggggacgcgccggcgctgcggcgttggcgcagtcgtgggaacagcgcggagcagagaagcaccaaaagaggcaaactgagatgcagacaaatgatcatccgtatgctgatcattttgaatagagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaaga

SEQ ID NO: 147627 - DNA, 657 bp, Homo sapiens
  Payload ID: 9208
  Gene Symbol: LCA5L
  Gene Name: Leber congenital amaurosis 5-like
  ENST ID: ENST00000451131
  CDS Start-End: 626-657
gcgcagtcgtgggaacagcgcggagcagtctgtcagcactgccttcaaaatgcacccagaatagattcacaattctaccatttctctcaaccgccactgtcaccaccttggtccaggcccccatcatctgagaagcaccaaaagaggcaaactgagatgcagacaaatgatcatccgtatgctgatcattttgaatagttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccagtgaggagattgtggactgcctaatatatttcatcagaagagaaggctggagaattaagcagatgcagcaaaaagcagaaactgacttcaaaaaaaaccctctcagtagagaaagtgatattagattcctattgcaaaggatctaatgccagttaaattctcttttgctttcttgataaaacaggagaattgagaattaaatgaaaaggtaaatccttttaaagacctcagaagatggatctgtttgtttcaatctgcttttgaggttgtttgctatgtctttggctgatctaacaaaaacaaatat

SEQ ID NO: 147628 - DNA, 885 bp, Homo sapiens
  Payload ID: 9208
  Gene Symbol: LCA5L
  Gene Name: Leber congenital amaurosis 5-like
  ENST ID: ENST00000418018
  CDS Start-End: 318-885
cggcgttggcgcagtcgtgggaacagcgcggagcagagaagcaccaaaagaggcaaactgagatgcagacaaatgatcatccgtatgctgatcattttgaataagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatg

SEQ ID NO: 147629 - DNA, 849 bp, Homo sapiens
  Payload ID: 9208
  Gene Symbol: LCA5L
  Gene Name: Leber congenital amaurosis 5-like
  ENST ID: ENST00000438404
  CDS Start-End: 566-849
ggccccgctgctgccgtcgtccccctcagccggttaccctgttacagccccagctctgggcccttccggaccctcctgctacgctctttctgggcttccagtatcgccggtcactcagtcctcgcccctgcctgcctcgctggcgccccgccgtttcctcctcgcggcacagtttgccaaggaacagctaccccggctcggcagtgaccgggcgccccggcgacacacgtactctcaggcccgctgggcagggggacggcctgggccgagtctgtcagcactgccttcaaaatgcacccagaatagattcacaattctaccatttctctcaaccgccactgtcaccaccttggtccaggcccccatcatctgagaagcaccaaaagaggcaaactgagatgcagacaaatgatcatccgtatgctgatcattttgaataatgaaaagcggaatctaatttgcatttcattatgagagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaa

SEQ ID NO: 147630 - DNA, 804 bp, Homo sapiens
  Payload ID: 9208
  Gene Symbol: LCA5L
  Gene Name: Leber congenital amaurosis 5-like
  ENST ID: ENST00000448288
  CDS Start-End: 483-804
ggggacgcgccggcgctgcggcgttggcgcagtcgtgggaacagcgcggagcaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccagtgaggagattgtggactgcctaatatatttcatcagaagagaaggctggagaattaagcagatgcagcaaaaagcagaaactgacttcaaaaaaaaccctctcagtagagaaagtgatattagattcctattgcaaaggatctaatgccagttaaattctcttttgctttcttgataaaacaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaag

SEQ ID NO: 147631 - DNA, 612 bp, Homo sapiens
  Payload ID: 9208
  Gene Symbol: LCA5L
  Gene Name: Leber congenital amaurosis 5-like
  ENST ID: ENST00000456017
  CDS Start-End: 521-612
atggggacgcgccggcgctgcggcgttggcgcagtcgtgggaacagcgcggagcagagaagcaccaaaagaggcaaactgagatgcagacaaatgatcatccgtatgctgatcattttgaataagaccaaaacctgtcaaaaaaatactaccgtggaaagctcataaatactacagtgtgaagaaccctgtgcttatcttcagtttatcatcagacatcttagggaagtttaataaagaacaccagtgaggagattgtggactgcctaatatatttcatcagaagagaaggctggagaattaagcagatgcagcaaaaagcagaaactgacttcaaaaaaaaccctctcagtagagaaagtgatattagattcctattgcaaaggatctaatgccagttaaattctcttttgctttcttgataaaacaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagag

SEQ ID NO: 147632 - DNA, 808 bp, Homo sapiens
  Payload ID: 9208
  Gene Symbol: LCA5L
  Gene Name: Leber congenital amaurosis 5-like
  ENST ID: ENST00000411566
  CDS Start-End: 530-808
gcggagcaggtaacggccccgctgctgccgtcgtccccctcagccggttaccctgttacagccccagctctgggcccttccggaccctcctgctacgctctttctgggcttccagtatcgccggtcactcagtcctcgcccctgcctgcctcgctggcgccccgccgtttcctcctcgcggcacagtttgccaaggaacagctaccccggctcggcagtgaccgggcgccccggcgacacacgtactctcaggcccgctgggcagggggacggcctgggccgaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaag

SEQ ID NO: 147633 - DNA, 690 bp, Homo sapiens
  Payload ID: 9208
  Gene Symbol: LCA5L
  Gene Name: Leber congenital amaurosis 5-like
  ENST ID: ENST00000426783
  CDS Start-End: 502-690
ccggcgctgcggcgttggcgcagtcgtgggaacagcgcggagcagccttcagccatgcttctgccactgcctctgcaggaaagccacctgctttaaaaaaaagtcttcatggagtgcttatgagagggtcggctgttttctccagctcatttttccaaagcaaacaatcccaccagctatctcaggcaagaaacacataatccaaaaactttaattatttatgttcaactctgtactggaaagaaagagcaggcaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttct

SEQ ID NO: 147634 - DNA, 2551 bp, Homo sapiens
  Payload ID: 9208
  Gene Symbol: LCA5L
  Gene Name: Leber congenital amaurosis 5-like
  ENST ID: ENST00000485895
  CDS Start-End: 299-1165
gggacgcgccggcgctgcggcgttggcgcagtcgtgggaacagcgcggagcaggttttttaaaatatattctttctttaaaaagagaccaaaacctgtcaaaaaaatactaccgtggaaagctcataaatactacagtgtgaagaaccctgtgcttatcttcagtttatcatcagacatcttagggaagtttaataaagaacaccaggagaattgagaattaaatgaaaaggtaaatccttttaaagacctcagaagatggatctgtttgtttcaatctgcttttgaggttgtttgctatgtctttggctgatctaacaaaaacaaatatagatgagcatttcttcggcgtggcattagaaaacaataggaggtctgcagcatgcaagagaagcccaggcacaggcgatttttcacggaacagtaatgcttccaataagagtgttgattatagcagatctcagtgctcctgtggaagtttaagttctcagtatgattattcagaagactttctctgtgattgttcagaaaaggctattaatagaaattatttaaagcagcctgtggtaaaagaaaaggagaagaaaaagtataatgtttctaaaatctcccaatctaaaggccagaaggaaatatcagttgaaaaaaagcacacctggaatgcatcactctttaattctcaaatccatatgattgcccaaagaagagatgctatggctcatcgaatactctcagcaaggcttcataaaattaaaggactaaaaaatgaattagctgatatgcatcataaattggaagccatccttacagaaaaccaatttttgaaacaacttcagcttaggcatttgaaagctataggaaaatatgagaattcacaaaataatctacctcaaattatggctaaacatcagaatgaagtaaaaaatttaaggcaactacttaggaaatcccaggaaaaggaaagaactctatctaggaaacttagagaaactgacagccagttactgaagactaaagatatcttgcaggcactgcagaaactttctgaagacaaaaaccttgcagaaagggaagaactcactcataaattatctattatcacaacaaaaatggacgcaaatgacaaaaaaatacaggtctgtatttcaggggcccagacagtttaagattccaaagttaatagagagagggtgtgaattaatcatggatgcgccccctctgtaacaaagcattactaactgcttcacttggcgtgctgcactaaataattatgttgtctaatagagggcacagaaagggagtggtttgaaggaaaaacagaagcagctcaaactagaaatgttcatctgttgcagtgcacaagagttcactctgtggctggactggtttatctggaaatgaccattctctaagagagcacagctacagtgctaagggactttttccctgtgctgaaaagattgcattgtgttacgtgaaacctctctttgaagtcaaccctctaccttaaactgttgattaaaaggctacttccctaaaaacctactcagtgcatccgttcagggcctttgtattctccctcaccattttggccaggaattaccacacagacatttgtagttattttcaaaatagcagcttttcccagataatgttcctgggtagtagggaaggaaaaggaattaaaataattaaagagatgactggattgattttcctcaacagcacttggttgtcaaaagcctggggattacattataagggatgacttgggagaaggcattgatatcatattaagaattctcctgcatatcttacattagctagtttgagtctgtatagacataaacataaatggaattaatttaggatttaattctgtaatatttgatgctgaaacacgagtattttctatgatcttgaagtaagtaaatatcaggttcgtttcctccacgttttaatctcagttatttcttctgttgttaaaattccctattttccaataaatttttttcacatgaaattaatatgtgatctacagaaaataatgagcaacctcaattttcactcttgtataccaaagtgatattattgggccttttaggtaatattgtattcatcttagcgtatgtctgtcatgtaaaagcaaatctgttttcatgtatgtatctaagttgttcatgtttttatatctatacataaaaccaaaacaaattccataactattttctttgatacaaaaagcacttaccaagtatgagaaatttctgtttggttgtaggcatttagtggaggaaaactgttttgtggaccaaaacatgttatttctttaacattaatgttttagggagtggtatttttagtgattctttccccttgtagctttccatgtcttccacttttcctgtttgggaaagtactgctgttataatggaggaggtcctactttatgttaaaacaaagaaaagtggtccttttggtaagctttctgtcaagtccagatctaacagttctccaataaaatagttctcattccagagagcagatgaata

SEQ ID NO: 147635 - DNA, 4928 bp, Homo sapiens
  Payload ID: 9209
  Gene Symbol: LRAT
  Gene Name: lecithin retinol acyltransferase (phosphatidylcholine--retinol O-acyltransferase)
  Uniprot ID: O95237
  ENST ID: ENST00000336356
  CDS Start-End: 254-946
taaaaagtcgcagcgaagcctgcacctccgagcaccgcgcgcggccctgcccccggcacggcccccaggtgcgctccttctccggctgcttgtagcactggtctcactgtccccgccgtcagccaccggttccttatccgtctcattccccattgtggcttggctgagccggtcgccaggcctcgctgtcctcctttgccttcctctctcctcagcggccgtactttgcgccgtacctcacctggcctgcaggatgaagaaccccatgctggaggtggtgtctttactactggagaagctgctcctcatctccaacttcacgctctttagttcgggcgccgcgggcgaagacaaagggaggaacagtttttatgaaaccagctctttccaccgaggcgacgtgctggaggtgccccggacccacctgacccactatggcatctacctaggagacaaccgtgttgcccacatgatgcccgacatcctgttggccctgacagacgacatggggcgcacgcagaaggtggtctccaacaagcgtctcatcctgggcgttattgtcaaagtggccagcatccgcgtggacacagtggaggacttcgcctacggagctaacatcctggtcaatcacctggacgagtccctccagaaaaaggcactgctcaacgaggaggtggcgcggagggctgaaaagctgctgggctttaccccctacagcctgctgtggaacaactgcgagcacttcgtgacctactgcagatatggcaccccgatcagtccccagtccgacaagttttgtgagactgtgaagataattattcgtgatcagagaagtgttcttgcttcagcagtcttgggattggcgtctatagtctgtacgggcttggtatcatacactacccttcctgcaatttttattccattcttcctatggatggctggctaacttcatacccccatgtcagtgtgtgtattctgtatgtaaatatgtttatatttatagagcatcaatcaatataagcattattgagaaaaatgtgacccgtaacactgtgttctggataaaaatgtgattaggaatcacgcaaagtgcttactgtgtaagcccaagaacaaaggctttctgaatcttctcaggcagttcagatttaaagcaccatccaaaccttggaaatacgacagggtgtggtagaattcagcaatatgagaaaaccagcccctaaaatgatagccacaagagattaattgtgtttttttttctcctgtaatccttgtactgttcggctgaatttgaagattggaagacttatattgagaccagtaactttactgtaaatttactttgtttcattgaaaaaacaaattgataaacatattaaactggaagaattttctttattcaaatgaaaacatgtttgatgactggtcaaaaaataagctcataatctatttttttcatgtagtatataagtcaagaatgttttattgtcattatgtgaaaccaatattggcaaatagtactttaatgatgaagtaaatgaccagaaattatagaaatctgtgttttcctgtaaaaatagcactatagtatcacttgaacaatttgatttggctttacttactaggaagcctggaattcattatttttttccttttatgtgccactgtggctactttaaatcactctgagaggtaaatggatataggattgaagttatgtgggtatttggcatgtgtgtgtgaaataaatatgtagatagtcacatatacacagactgagagataaattgttcttgattgctttattatcatcatactagtgtgttcattatagagtatctgtagaggtgaatgtaaaagtaagtccaatctattttcttatgtcattgaatttgtagtgttaacttgcatatatgttattggatgggttgtcttttaaagcatttactaatgtactctgaaatttttaaaagccttcagatttgttttctagtcacttttttccatatcatttctaattatagtttatatccttaaaagaaggatgccacagtagtatgtaaaacccaaacaagtagaacccaagcaaataaaattatttaaaataattttaaagtggcttagtactgccagtcatgtaaattgattctgctgagggtcttataagaattgagatataacaatggtaaaacaagcattcaagcacttttacaaaattaccaaattcttaaaatgaagccacagctagacttgcatttcaggtattaaaattgctttcttaactgtcaagaatcacaaaataacaaatcatattatgagtgaatatggggagggcggggccaatcagtcaatgataatctgaacaaattttaagagcagattttagattaataatgttttatcaccactaatttgcccacaacaaactcagtatttaatttttcaaattaaatattaaattatttaagtattttaaataattaaaacattaaatggcaacaccatagaatataggtgttctctggacctattctaaccacttaaaattatcttaagtatgcatacataaaagcaaccactatgagaactaccgtgttagtggtttttcacttactgtatattacccttgtaggaatagtttaaggaaattcatttcttaaaaatatagtgtcctcaaataattaatttttttgcaaactttagttattacaggcagcaaaaaccactgtctgaaactaaatctgtgttcaaagatgaagacccctcattaaaagccaaggacgttcttaagattggaactgacataattagtcttgacttacttcattaaagcaagattcaattccttgttcatttgagtgttcattatatgccaggcattgaccagttgcaattttatggtccagaattaatattattattcgtaaactagctataatagagtatatacagtgctgtgggaatacaggggaagaagcaattaaatctgctagaagggtaagagaaatctgtatgcaggaggcaatgctagcattaagccaagaaatagtgtgaggtgatcttatcacactgatgtgttcaactgtttatgggaaaaggaaactaggatggttttatttgtgaaatgttctacaacgctagaactgttgaacttcttgggagaaaaggagaatctttgttttgttgtgctgagtttgattagttgcttaaccaagtagaaagaaaagcacatcttcctgatcacagttataaaagaaaccctgaggccgggcgcggtggctcaagcctgtaaccccagcactttgggaggccaaggagggaggatcacaaggtcaggagatcgagaccatcctggctaacacggtgaaaccccatctctactaaaaatacaaaattagctgggcgtggtggccggcgcctgtagtcccagctactcatgaggttgaggcaggagaatggcgtgaaccgaggaggcggagcttgcagtgagtggaaattgcgccactgcactccagcctgggcaacaaagtgagactccatctcaaaaaaaaaaaaaaaaaaaaaaaaaaaaaaagaagaagaaaccctgagccattaatgtgtctcgtaacttgaggaagttcatgaattctctgggcttcatccattaagattcatccttatgctcctgcaagtttcttatatttatgtatttctattctgatttctgaaatgataacctagtagtgtctgatgaagttttttcatgcttattttattctttgtcacagatgaaagaagaataggactaattggggctaagatgaattaatgtaagtgtcagatactaggcaggtgttagggatgaaatgatgaatgaggcatggacctgttcctcagagtttatggcccagtagacataattgtattaggactttctgcagttgacatttgcataaagctgactgactgaaggaacagaaagtgagacagacagatatgaccaaatttatacaaaccatgtaccaacacttgaaagatgggtggatattttccaggaaacagattttgggcaggacattccatgcactggaaatagcatgaacaaatgcatgaaaattgcctacaacatgcctggcacatagctgtgaggtaccctatgagttgttgacttgaaaacatggaactgcacagggcattcaggcaagtgcaagtggttcaggggccagcgcagagcagagtgctgagtaaagatgtcagaaaaggaaagcaatggtctggtacaagtcttgtatagaacaagaagtttagacttttgaacaggcaatcgagatttggggttcagaaagataaatcccaaaagtatggagaacaaaggaactcattttaaaggactagctaagatgctcaatctctaaaaaaaaaaggatctgtattcgtgagagtagagagaaaggttgtttaggaagagtcaacagactttagcaaaatccttttatttgattcatgcataactcctgatggagtgtcaaggaagactcattcacttttctttcctgccagaaagttggttcttgcaaaatagattaacttgatgactatgtgtatattggatactcctaattttagctctgttagatatgtttctttctaaggacaagcaactatgtatagacttgttgtttgaattttttttcagtatatatatgtttcttgtttttctatttttctacttcatactgttaatgtcaaatatcaaaaatgttttccagcaatatcaagttatggcaatggcaaaagtccttgttgtagatgagaagcatataagaaatggttgccaatctttgttttgtatgatctatttagagttttaaccaacctagatctgtcagctaagctaattttatatttggtatacatgcatgtcaaataaagttaattttacatac

SEQ ID NO: 147636 - DNA, 546 bp, Homo sapiens
  Payload ID: 9209
  Gene Symbol: LRAT
  Gene Name: lecithin retinol acyltransferase (phosphatidylcholine--retinol O-acyltransferase)
  ENST ID: ENST00000502525
  CDS Start-End: 340-546
tctgctcctcgggcggccttgagcagtgcctaacgttgagcgtgaggctcgtgctccgggtctcgcgggcggccgcctcgggcgtcgagtcccggagattggacagacaccagagcctggggaccgcggagtgaccgggtggggctggagggcggcgccgcgccttctggggagacgcggaggtatcaggacctgggctatgctcctgattttatacagactgccatggctccagatataaaagaccaaataaaaagataagaattgctggcaacatatgcactaaacttcgttttgaaaaatccccttgatgccgatcactgagaagtgatccacaggatgaagaaccccatgctggaggtggtgtctttactactggagaagctgctcctcatctccaacttcacgctctttagttcgggcgccgcgggcgaagacaaagggaggaacagtttttatgaaaccagctctttccaccgaggcgacgtgctggaggtgccccggacccacctgacccactatggcatctacctaggagacaaccgt

SEQ ID NO: 147637 - DNA, 2654 bp, Homo sapiens
  Payload ID: 9209
  Gene Symbol: LRAT
  Gene Name: lecithin retinol acyltransferase (phosphatidylcholine--retinol O-acyltransferase)
  Uniprot ID: O95237
  ENST ID: ENST00000507827
  CDS Start-End: 63-755
acagaatgtagccacctttcttaacggtccgggaaaccagaggtctctccagctactcagggatgaagaaccccatgctggaggtggtgtctttactactggagaagctgctcctcatctccaacttcacgctctttagttcgggcgccgcgggcgaagacaaagggaggaacagtttttatgaaaccagctctttccaccgaggcgacgtgctggaggtgccccggacccacctgacccactatggcatctacctaggagacaaccgtgttgcccacatgatgcccgacatcctgttggccctgacagacgacatggggcgcacgcagaaggtggtctccaacaagcgtctcatcctgggcgttattgtcaaagtggccagcatccgcgtggacacagtggaggacttcgcctacggagctaacatcctggtcaatcacctggacgagtccctccagaaaaaggcactgctcaacgaggaggtggcgcggagggctgaaaagctgctgggctttaccccctacagcctgctgtggaacaactgcgagcacttcgtgacctactgcagatatggcaccccgatcagtccccagtccgacaagttttgtgagactgtgaagataattattcgtgatcagagaagtgttcttgcttcagcagtcttgggattggcgtctatagtctgtacgggcttggtatcatacactacccttcctgcaatttttattccattcttcctatggatggctggctaacttcatacccccatgtcagtgtgtgtattctgtatgtaaatatgtttatatttatagagcatcaatcaatataagcattattgagaaaaatgtgacccgtaacactgtgttctggataaaaatgtgattaggaatcacgcaaagtgcttactgtgtaagcccaagaacaaaggctttctgaatcttctcaggcagttcagatttaaagcaccatccaaaccttggaaatacgacagggtgtggtagaattcagcaatatgagaaaaccagcccctaaaatgatagccacaagagattaattgtgtttttttttctcctgtaatccttgtactgttcggctgaatttgaagattggaagacttatattgagaccagtaactttactgtaaatttactttgtttcattgaaaaaacaaattgataaacatattaaactggaagaattttctttattcaaatgaaaacatgtttgatgactggtcaaaaaataagctcataatctatttttttcatgtagtatataagtcaagaatgttttattgtcattatgtgaaaccaatattggcaaatagtactttaatgatgaagtaaatgaccagaaattatagaaatctgtgttttcctgtaaaaatagcactatagtatcacttgaacaatttgatttggctttacttactaggaagcctggaattcattatttttttccttttatgtgccactgtggctactttaaatcactctgagaggtaaatggatataggattgaagttatgtgggtatttggcatgtgtgtgtgaaataaatatgtagatagtcacatatacacagactgagagataaattgttcttgattgctttattatcatcatactagtgtgttcattatagagtatctgtagaggtgaatgtaaaagtaagtccaatctattttcttatgtcattgaatttgtagtgttaacttgcatatatgttattggatgggttgtcttttaaagcatttactaatgtactctgaaatttttaaaagccttcagatttgttttctagtcacttttttccatatcatttctaattatagtttatatccttaaaagaaggatgccacagtagtatgtaaaacccaaacaagtagaacccaagcaaataaaattatttaaaataattttaaagtggcttagtactgccagtcatgtaaattgattctgctgagggtcttataagaattgagatataacaatggtaaaacaagcattcaagcacttttacaaaattaccaaattcttaaaatgaagccacagctagacttgcatttcaggtattaaaattgctttcttaactgtcaagaatcacaaaataacaaatcatattatgagtgaatatggggagggcggggccaatcagtcaatgataatctgaacaaattttaagagcagattttagattaataatgttttatcaccactaatttgcccacaacaaactcagtatttaatttttcaaattaaatattaaattatttaagtattttaaataattaaaacattaaatggcaacaccatagaatataggtgttctctggacctattctaaccacttaaaattatcttaagtatgcatacataaaagcaaccactatgagaactaccgtgttagtggtttttcacttactgtatattacccttgtaggaatagtttaaggaaattcatttcttaaaaatatagtgtcctcaaataattaatttttttgcaaactttagttattacaggcagcaaaaaccactgtctgaaactaaatctgtgttcaaagatgaagacccctcattaaaagccaaggacgttcttaagattggaactgacataattagtcttgacttacttcattaaagcaagattcaattc

SEQ ID NO: 147638 - DNA, 1507 bp, Homo sapiens
  Payload ID: 9210
  Gene Symbol: LCAT
  Gene Name: lecithin-cholesterol acyltransferase
  Uniprot ID: P04180
  ENST ID: ENST00000264005
  CDS Start-End: 31-1353
ctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcgtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgtaagccctgatggctatgtttcaggttgaagggaggcactagagtcccacactaggtttcactcctcaccagccacaggctcagtgctgtgtgcagtgaggcaagatgggctctgctgaggcctgggactgagct

SEQ ID NO: 147639 - DNA, 359 bp, Homo sapiens
  Payload ID: 9210
  Gene Symbol: LCAT
  Gene Name: lecithin-cholesterol acyltransferase
  ENST ID: ENST00000576450
  CDS Start-End: 1-241
ggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcagggagtggcaccagggcccagcactgacacagctaccacctactccccaccccctgtaccctgggagctggtctggagagagaaacacagtctggacaagagaaacgctcatcagacaccaccaataaacatcaaacagacacca

SEQ ID NO: 147640 - DNA, 348 bp, Homo sapiens
  Payload ID: 9210
  Gene Symbol: LCAT
  Gene Name: lecithin-cholesterol acyltransferase
  ENST ID: ENST00000570369
  CDS Start-End: 1-322
cctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgtaa

SEQ ID NO: 147641 - DNA, 322 bp, Homo sapiens
  Payload ID: 9210
  Gene Symbol: LCAT
  Gene Name: lecithin-cholesterol acyltransferase
  ENST ID: ENST00000570396
  CDS Start-End: 1-186
agccccaggcctggaaggaccgctttattgatggcttcatctctcttggggctccctggggtggctccatcaagcccatgctggtcttggcctcaggagtgcctttgcccagggatgtgcttcactgaggatggatctgccagagctagggccagaccccccgaggccccacctgctcttccctagggagtggcaccagggcccagcactgacacagctaccacctactccccaccccctgtaccctgggagctggtctggagagagaaacacagtctggacaagagaaacgctcatcagacaccaccaataaacatcaaac

SEQ ID NO: 147642 - DNA, 842 bp, Homo sapiens
  Payload ID: 9210
  Gene Symbol: LCAT
  Gene Name: lecithin-cholesterol acyltransferase
  ENST ID: ENST00000575467
  CDS Start-End: 31-312
ctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcgctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcagagatgaggtcttgctatgttgcccaggctggtctcaaactcttcaccttaagtgatcttcctgcctcagcctcccgaagtgctggga

SEQ ID NO: 147643 - DNA, 1083 bp, Homo sapiens
  Payload ID: 9210
  Gene Symbol: LCAT
  Gene Name: lecithin-cholesterol acyltransferase
  ENST ID: ENST00000573538
  CDS Start-End: 1-417
gtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcagagacagggtctcactgcattgcctagtctggtcacggactcctggcctcaagtgatcctcctgcctcagcctcccaaagtgttgggattacaggggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgtaa

SEQ ID NO: 147644 - DNA, 1240 bp, Homo sapiens
  Payload ID: 9210
  Gene Symbol: LCAT
  Gene Name: lecithin-cholesterol acyltransferase
  ENST ID: ENST00000570980
  CDS Start-End: 476-1240
ggcccccacccaccaaggacaagatgcccagcccaggatcggtgagcaggagaggcccatccatgcccggcccctattaggcccagcccccatgcccccagacctatctgttcccaccttggactttggcaataaaggagcgccagactgggtgtttgctctgcagaggcaggggtcagcggccttggcctcagcacctcagcgccttcccttcctcagggaagcctgggctttggctactggggggacagcagggagagggggtgtaagcaggggagggtaagtgtgctttgtacctgggggttgagggtatgggaggtggggggtgggtctggtcactgcagcatctggggtgacgggggtaagggtcacggggggaatccagagtccagagtgagggctgctgctcacagtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccagggttgtctacaaccggagctctgggctcgtgtccaacgcccctggtgtccagatccgcgtccctggctttggcaagacctactctgtggagtacctggacagcagcaagctggcagggtacctgcacacactggtgcagaacctggtcaacaatggctacgtgcgggacgagactgtgcgcgccgccccctatgactggcggctggagcccggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcagga

SEQ ID NO: 147645 - DNA, 560 bp, Homo sapiens
  Payload ID: 9211
  Gene Symbol: LGALS1
  Gene Name: lectin, galactoside-binding, soluble, 1
  Uniprot ID: P09382
  ENST ID: ENST00000215909
  CDS Start-End: 96-503
ttaaaagggtgggagcgtccgggggcccatctctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaccag

SEQ ID NO: 147646 - DNA, 331 bp, Homo sapiens
  Payload ID: 9211
  Gene Symbol: LGALS1
  Gene Name: lectin, galactoside-binding, soluble, 1
  ENST ID: ENST00000454173
  CDS Start-End: 16-132
ctcctggactcaatcatggcttgtggtctggtcgccagcaacctgaatctcaaacctggagagtgccttcgagtgcgaggcgaggtggctcctgacgctaagagtgagttcttccagcaagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaa

SEQ ID NO: 147647 - DNA, 637 bp, Homo sapiens
  Payload ID: 9211
  Gene Symbol: LGALS1
  Gene Name: lectin, galactoside-binding, soluble, 1
  ENST ID: ENST00000425542
  CDS Start-End: 47-256
ctgacagctggtgcgcctgcccgggaacatcctcctggactcaatcatggcttgtgcttccccttggcttggtcagaggatgccgggcgggaacaaccccactcccacccccagccacccccggacacttcgagcagtggaggccttgtcctctaacccggctgggccggggcttgtctgtgcagggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaa

SEQ ID NO: 147648 - DNA, 1667 bp, Homo sapiens
  Payload ID: 9212
  Gene Symbol: LGALS12
  Gene Name: lectin, galactoside-binding, soluble, 12
  Uniprot ID: Q96DT0
  ENST ID: ENST00000255684
  CDS Start-End: 310-1293
acaaaccctcgttggccccacaggagccagcctctggcttctctctgcaatggccatgtgctgcagacccggagtgggtagttagttggttaatgccagtcttcctcccctggacactgagttctgctgacagcccccgcccagccagagctctgctgtataccaccgggagtggggctggtgtggagcctggaggtcgcccgctgccctcctagggctgctccagacagcattaaaacgctgcaggtcgcaggtgagactaacagctgggagagctgctccaggcatttaggaccctgactggggcagatgagtcagcccagtgggggcagggctcctggaacgaggatctacagttggagttgccccactgtcatgtcacctggagaaaaactggacccaattcctgacagcttcattctgcaaccaccagtcttccacccggtggttccttatgtcacgacgatttttggaggcctgcatgcaggcaagatggtcatgctgcaaggagtggtccctctagatgcacacaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatgaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaatgtggtcatttattctttattatttatttatttgtggtcaaataaataaataaggtta

SEQ ID NO: 147649 - DNA, 1425 bp, Homo sapiens
  Payload ID: 9212
  Gene Symbol: LGALS12
  Gene Name: lectin, galactoside-binding, soluble, 12
  Uniprot ID: Q96DT0
  ENST ID: ENST00000340246
  CDS Start-End: 31-1044
tccaggcatttaggaccctgactggggcagatgagtcagcccagtgggggcagggctcctggaacgaggatctacagttggagttgccccactgtcatgtcacctggagaaaaactggacccaattcctgacagcttcattctgcaaccaccagtcttccacccggtggttccttatgtcacgacgatttttggaggcctgcatgcaggcaagatggtcatgctgcaaggagtggtccctctagatgcacacagtaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatcctttcctgctgatgagccccaggctggaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaatgtggtcatttattctttattatttatttatttgtggtcaaataaataaataaggttatttattt

SEQ ID NO: 147650 - DNA, 1618 bp, Homo sapiens
  Payload ID: 9212
  Gene Symbol: LGALS12
  Gene Name: lectin, galactoside-binding, soluble, 12
  Uniprot ID: Q96DT0
  ENST ID: ENST00000394618
  CDS Start-End: 292-1302
cacaggagccagcctctggcttctctctgcaatggccatgtgctgcagacccggagtgggtagttagttggttaatgccagtcttcctcccctggacactgagttctgctgacagcccccgcccagccagagctctgctgtataccaccgggagtggggctggtgtggagcctggaggtcgcccgctgccctcctagggctgctccagacagcattaaaacgctgcaggtcgcaggtgagactaacagctgggagagctgctccaggcatttaggaccctgactggggcagatgagtcagcccagtgggggcagggctcctggaacgaggatctacagttggagttgccccactgtcatgtcacctggagaaaaactggacccaattcctgacagcttcattctgcaaccaccagtcttccacccggtggttccttatgtcacgacgatttttggaggcctgcatgcaggcaagatggtcatgctgcaaggagtggtccctctagatgcacacaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatcctttcctgctgatgagccccaggctggaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaa

SEQ ID NO: 147651 - DNA, 1816 bp, Homo sapiens
  Payload ID: 9212
  Gene Symbol: LGALS12
  Gene Name: lectin, galactoside-binding, soluble, 12
  Uniprot ID: Q96DT0
  ENST ID: ENST00000415491
  CDS Start-End: 615-1442
cctcagcttcccagagtgctgagattacaggcatgagccacagagcccagcccaggtaacttctacatggggaaaggtgagcctgggaaggccattgttaagtgcctctccaggggtccatttcagagttagctgtcagttcctaacttgtccattcttcttgcctcccagttcctagtctccagccactcaacagtcctcagaaagccccagtaccaggcttctggggaccagggtgacatctagtggatggcaagcctccctggggtcactgcagcctgttgtgtcctaggagctggggaaaggcaactggctggtgctgaatttggcaagggagcggaatttgacttctctggtgtaatgcagctttgccgtgtgacggtccaggaaaggggattaggtggaagaaaatatttcagtgaacactgatttttacctataaggaattttctgtttggagaggaaaagttgagttttattctgctcctttcctcccactcgcctgacatagaggtccctaagccctttctccaaacctgcatggatgagtttcttttcttgttcaggtggttccttatgtcacgacgatttttggaggcctgcatgcaggcaagatggtcatgctgcaaggagtggtccctctagatgcacacaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatcctttcctgctgatgagccccaggctggaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaatgtggtcatttattctttattatttatttatttgtggtcaaataaataaataaggtta

SEQ ID NO: 147652 - DNA, 1789 bp, Homo sapiens
  Payload ID: 9212
  Gene Symbol: LGALS12
  Gene Name: lectin, galactoside-binding, soluble, 12
  Uniprot ID: Q96DT0
  ENST ID: ENST00000425950
  CDS Start-End: 615-1415
cctcagcttcccagagtgctgagattacaggcatgagccacagagcccagcccaggtaacttctacatggggaaaggtgagcctgggaaggccattgttaagtgcctctccaggggtccatttcagagttagctgtcagttcctaacttgtccattcttcttgcctcccagttcctagtctccagccactcaacagtcctcagaaagccccagtaccaggcttctggggaccagggtgacatctagtggatggcaagcctccctggggtcactgcagcctgttgtgtcctaggagctggggaaaggcaactggctggtgctgaatttggcaagggagcggaatttgacttctctggtgtaatgcagctttgccgtgtgacggtccaggaaaggggattaggtggaagaaaatatttcagtgaacactgatttttacctataaggaattttctgtttggagaggaaaagttgagttttattctgctcctttcctcccactcgcctgacatagaggtccctaagccctttctccaaacctgcatggatgagtttcttttcttgttcaggtggttccttatgtcacgacgatttttggaggcctgcatgcaggcaagatggtcatgctgcaaggagtggtccctctagatgcacacaggtttcaggtggacttccagtgtggctgcagcctgtgtccccggccagatatcgccttccacttcaaccctcgcttccataccaccaagccccatgtcatctgcaacaccctgcatggtggacgctggcaaagggaggcccggtggccccacctggccctgcgaagaggctccagcttcctcatcctctttctcttcgggaatgaggaagtgaaggtgagtgtgaatggacagcactttctccacttccgctaccggctcccactgtctcatgtggacacgctgggtatatttggtgacatcctggtagaggctgttggattcctgaacatcaatccatttgtggagggcagcagagagtacccagctggacatgaggtgccctgctcacatgctcttccccagggtctctcgcctgggcaggtcatcatagtacggggactggtcttgcaagagccgaagcattttactgtgagcctgagggaccaggctgcccatgctcctgtgacactcagggcctccttcgcagacagaactctggcctggatctcccgctgggggcagaagaaactgatctcagcccccttcctcttttacccccagagattctttgaggtgctgctcctgttccaggagggagggctgaagctggcgctcaatgggcaggggctgggggccaccagcatgaaccagcaggccctggagcagctgcgggagctccggatcagtggaagtgtccagctctactgtgtccactcctgaggatggttccagggaaataccgccagaaaacaagaaggtcagcccactcccagggccccactctcctcccctcattaaaccatccacctgacaccagcacatcaggcctggttcacctctggggtcacgagactgagtctacaggagctttgggcctgagggaaggcacaagagtgcaaaggttcctcgaactctgcaccttcctccaccaggagcctgggatatggctccatctgccttcagggcctggactgcactcacagaggcaagtgttgtagactaacaaagatactccaaaatacaatggcttaaagaatgtggtcatttattctttattatttatttatttgtggtcaaataaataaataaggtta

SEQ ID NO: 147653 - DNA, 602 bp, Homo sapiens
  Payload ID: 9213
  Gene Symbol: LGALS13
  Gene Name: lectin, galactoside-binding, soluble, 13
  Uniprot ID: Q9UHV8
  ENST ID: ENST00000221797
  CDS Start-End: 46-465
agaagactggactcaattctgaaggtcgccaagaaggagagaacaatgtcttctttacccgtgccatacaaactgcctgtgtctttgtctgttggttcctgcgtgataatcaaagggacaccaatccactcttttatcaatgacccacagctgcaggtggatttctacactgacatggatgaggattcagatattgccttccgtttccgagtgcactttggcaatcatgtggtcatgaacaggcgtgagtttgggatatggatgttggaggagacaacagactacgtgccctttgaggatggcaaacaatttgagctgtgcatctacgtacattacaatgagtatgagataaaggtcaatggcatacgcatttacggctttgtccatcgaatcccgccatcatttgtgaagatggtgcaagtgtcgagagatatctccctgacctcagtgtgtgtctgcaattgagggagatgatcacactcctcattgttgaggaatccctctttctacctgaccatgggattcccagaacctgctaacagaataatccctgctcacattttcccctacactttgtcattaaaacagcacgaaaactcaca

SEQ ID NO: 147654 - DNA, 282 bp, Homo sapiens
  Payload ID: 9213
  Gene Symbol: LGALS13
  Gene Name: lectin, galactoside-binding, soluble, 13
  ENST ID: ENST00000600141
  CDS Start-End: 33-282
caattctgaaggtcgccaagaaggagagaacaatgtcttctttacccctgcaggtggatttctacactgacatggatgaggattcagatattgccttccgtttccgagtgcactttggcaatcatgtggtcatgaacaggcgtgagtttgggatatggatgttggaggagacaacagactacgtgccctttgaggatggcaaacaatttgagctgtgcatctacgtacattacaatgagtatgagataaaggtcaatggcatacgcatttacggctttgtcc

SEQ ID NO: 147655 - DNA, 494 bp, Homo sapiens
  Payload ID: 9213
  Gene Symbol: LGALS13
  Gene Name: lectin, galactoside-binding, soluble, 13
  ENST ID: ENST00000621475
  CDS Start-End: 69-494
tgctgcaactcagagattcactcagaagactggactcaattctgaaggtcgccaagaaggagagaacaatgtcttctttacccgtgccatacaaactgcctgtgtctttgtctgttggttcctgcgtgataatcaaagggacaccaatccactcttttatcaatgacccacagctgcaggtggatttctacactgacatggatgaggattcagatattgccttccgtttccgagtgcactttggcaatcatgtggtcatgaacaggcgtgagtttgggatatggatgttggaggagacaacagactacgtgccctttgaggatggcaaacaatttgagctgtgcatctacgtacattacaatgagtatgagataaaggtcaatggcatacgcatttacggctttgtccatcgaatcccgccatcatttgtgaagatggtgcaagtgtcgagagatatctccctgacctcagtgtgtgtctgcaatgggagatga

SEQ ID NO: 147656 - DNA, 773 bp, Homo sapiens
  Payload ID: 9214
  Gene Symbol: LGALS14
  Gene Name: lectin, galactoside-binding, soluble, 14
  Uniprot ID: Q8TCE9
  ENST ID: ENST00000360675
  CDS Start-End: 267-773
acagaagactggacacaattccgaagagctgcccagaaggagagaacaatgtcatcactacccagtggcagacacctttcaccccagctacacaagagggggcagatgtgtgaggatcactgcagtccaggagttcgatgtttcagtgagctgtgattgcaccactgcatatcagcctgggtgacagagcaagaccctatctcaaaaatacagaaaaatcatcaaccacttgcagtcgtcgtagaaatcaatcattccctccagttatgtccctgacccacaggcttcatttgtgcaagtactggggctgtgctgtcagtaatgtgtgccgcttctgggaaggacgtccattgcccttgatgattgtggtaccatacacactgcctgtttccttgcctgttggttcgtgcgtgataatcacagggacaccgatcctcacttttgtcaaggacccacagctggaggtgaatttctacactgggatggatgaggactcagatattgctttccaattccgactgcactttggtcatcctgcaatcatgaacagttgtgtgtttggcatatggagatatgaggagaaatgctactatttaccctttgaagatggcaaaccatttgagctgtgcatctatgtgcgtcacaaggaatacaaggtaatggtaaatggccaacgcatttacaactttgcccatcgattcccgccagcatctgtgaagatgctgcaagtcttcagagatatctccctgaccagagtgcttatcagcgattga

SEQ ID NO: 147657 - DNA, 774 bp, Homo sapiens
  Payload ID: 9214
  Gene Symbol: LGALS14
  Gene Name: lectin, galactoside-binding, soluble, 14
  Uniprot ID: Q8TCE9
  ENST ID: ENST00000392052
  CDS Start-End: 224-643
gctgcattacagacacagacctgcaaacatctatggttgtgacagagtttctttctgacacctgagtctttctcctgctgcacggaaagcttgctgggaggggcttggaatctggcatgaagccaaagggcatctctgagttgcagcatttaaatgatcccactcagagattcacacagaagactggacacaattccgaagagctgcccagaaggagagaacaatgtcatcactacccgtaccatacacactgcctgtttccttgcctgttggttcgtgcgtgataatcacagggacaccgatcctcacttttgtcaaggacccacagctggaggtgaatttctacactgggatggatgaggactcagatattgctttccaattccgactgcactttggtcatcctgcaatcatgaacagttgtgtgtttggcatatggagatatgaggagaaatgctactatttaccctttgaagatggcaaaccatttgagctgtgcatctatgtgcgtcacaaggaatacaaggtaatggtaaatggccaacgcatttacaactttgcccatcgattcccgccagcatctgtgaagatgctgcaagtcttcagagatatctccctgaccagagtgcttatcagcgattgagggagatgatcagactcctcattgttgaggaatccctctttctacctgaccatgggattcccagagcctactaacagaataatccctcctcaccccttcccctacacttgatcattaaaacagcaccaaac

SEQ ID NO: 147658 - DNA, 469 bp, Homo sapiens
  Payload ID: 9214
  Gene Symbol: LGALS14
  Gene Name: lectin, galactoside-binding, soluble, 14
  ENST ID: ENST00000601802
  CDS Start-End: 1-370
cgaagagctgcccagaaggagagaacaatgtcatcactaccccaaggacccacagctggaggtgaatttctacactgggatggatgaggactcagatattgctttccaattccgactgcactttggtcatcctgcaatcatgaacagttgtgtgtttggcatatggagatatgaggagaaatgctactatttaccctttgaagatggcaaaccatttgagctgtgcatctatgtgcgtcacaaggaatacaaggtaatggtaaatggccaacgcatttacaactttgcccatcgattcccgccagcatctgtgaagatgctgcaagtcttcagagatatctccctgaccagagtgcttatcagcgattgagggagatgatcagactcctcattgttgaggaatccctctttctacctgaccatgggattcccagagcctactaacagaataatccctcctcaccccttc

SEQ ID NO: 147659 - DNA, 624 bp, Homo sapiens
  Payload ID: 9215
  Gene Symbol: LGALS16
  Gene Name: lectin, galactoside-binding, soluble, 16
  Uniprot ID: A8MUM7
  ENST ID: ENST00000392051
  CDS Start-End: 69-497
tgctgcaactcagagattcactcagaagactggacacaattccgaaggtcgcccagaaggagaggacaatgtcatttctaactgtgccatacaaactgcctgtgtctttgtctgttggttcctgcgtgataatcaaagggacactgatcgactcttctatcaacgaaccacagctgcaggtggatttctacactgagatgaatgaggactcagaaattgccttccatttgcgagtgcacttaggccgtcgtgtggtcatgaacagtcgtgagtttgggatatggatgttggaggagaatttacactatgtgccctttgaggatggcaaaccatttgacttgcgcatctacgtgtgtcacaatgagtatgaggtaaaggtaaatggtgaatacatttatgcctttgtccatcgaatcccgccatcatatgtgaagatgattcaagtgtggagagatgtctccctggactcagtgcttgtcaacaatggacggagatgatcacactcctcattgttgaggaaaccctctttctacctgaccatgggattcctagagcctgctaacagaataatccctcctcaaccccttcccctacacttggtcattaaaacagcaccaaaccgta

SEQ ID NO: 147660 - DNA, 654 bp, Homo sapiens
  Payload ID: 9215
  Gene Symbol: LGALS16
  Gene Name: lectin, galactoside-binding, soluble, 16
  ENST ID: ENST00000594480
  CDS Start-End: 44-226
aagactggacacaattccgaaggtcgcccagaaggagaggacaatgtcatttctaactgaagggagactgcacctgaccctgcacctctcacttattctcaataccctggcaggtgccatacaaactgcctgtgtctttgtctgttggttcctgcgtgataatcaaagggacactgatcgactcttctatcaacgaaccacagctgcaggtggatttctacactgagatgaatgaggactcagaaattgccttccatttgcgagtgcacttaggccgtcgtgtggtcatgaacagtcgtgagtttgggatatggatgttggaggagaatttacactatgtgccctttgaggatggcaaaccatttgacttgcgcatctacgtgtgtcacaatgagtatgaggtaaaggtaaatggtgaatacatttatgcctttgtccatcgaatcccgccatcatatgtgaagatgattcaagtgtggagagatgtctccctggactcagtgcttgtcaacaatggacggagatgatcacactcctcattgttgaggaaaccctctttctacctgaccatgggattcctagagcctgctaacagaataatccctcctcaaccccttcccctacacttggtcattaaaacagcaccaaaccgta

SEQ ID NO: 147661 - DNA, 591 bp, Homo sapiens
  Payload ID: 9216
  Gene Symbol: LGALS2
  Gene Name: lectin, galactoside-binding, soluble, 2
  Uniprot ID: P05162
  ENST ID: ENST00000215886
  CDS Start-End: 176-574
tgctgggtactgggagatgcaggcggggagacacaaggtagaaggggcaaagtcctcacctaggaccttgagggagttaatgtgtaatattctaggatataagcttgaccacgagttgagaccctgagcacaggcctccaggagccgctgggagctgccgccaggagctgtcaccatgacgggggaacttgaggttaagaacatggacatgaagccggggtcaaccctgaagatcacaggcagcatcgccgatggcactgatggctttgtaattaatctgggccaggggacagacaagctgaacctgcatttcaaccctcgcttcagcgaatccaccattgtctgcaactcattggacggcagcaactgggggcaagaacaacgggaagatcacctgtgcttcagcccagggtcagaggtcaagttcacagtgacctttgagagtgacaaattcaaggtgaagctgccagatgggcacgagctgacttttcccaacaggctgggtcacagccacctgagctacctgagcgtaaggggcgggttcaacatgtcctctttcaagttaaaagaataaaagacttccagccgaga

SEQ ID NO: 147662 - DNA, 406 bp, Homo sapiens
  Payload ID: 9216
  Gene Symbol: LGALS2
  Gene Name: lectin, galactoside-binding, soluble, 2
  ENST ID: ENST00000416480
  CDS Start-End: 318-406
actttctagttgcgtgagtcctgggatccctaattccccacctgaaaaatggggtgagaacagaggttcccttgagaatgtactatgagcttataacgatgagggctgaagaaagtggtttgcaaagtgcagaatgcccttcagaaggtagccattgttaagaggacaaggttacagatgcaaggaagctgggctaagtgagggaggctgggagagctgtcaagcggctgcattgcggatataagcttgaccacgagttgagaccctgagcacaggcctccaggagccgctgggagctgccgccaggagctgtcaccatgacgggggaacttgaggttaagaacatggacatgaagccggggtcaaccctgaagatcacaggcagcatcgccgatggcactgatgg

SEQ ID NO: 147663 - DNA, 1146 bp, Homo sapiens
  Payload ID: 9217
  Gene Symbol: LGALS3
  Gene Name: lectin, galactoside-binding, soluble, 3
  Uniprot ID: P17931
  ENST ID: ENST00000254301
  CDS Start-End: 262-1014
aggtcgcgcccctcagtgcccgcgctctccccgtcgggagcttcctggtcgcccctgcggcggcggctcggggtgtctggccggcgcggggctcgcccagcctggtccggggagaggactggctgggcaggggcgccgccccgcctcgggagaggcgggccgggcggggctgggagtatttgaggctcggagccaccgccccgccggcgcccgcagcacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggcctacccatcttctggacagccaagtgccaccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatatta

SEQ ID NO: 147664 - DNA, 916 bp, Homo sapiens
  Payload ID: 9217
  Gene Symbol: LGALS3
  Gene Name: lectin, galactoside-binding, soluble, 3
  ENST ID: ENST00000554715
  CDS Start-End: 46-747
cacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggcctacccatcttctggacagccaagtgccaccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaagtctcgctctgtcgccaggctggagtacagtggcacgatcttggctcactacaacctccgcctcctgggttcaagcgatgctcctgcctcagcctcccaagtagctgggattataggcgtgcgctaccatgcccagctaacttttgtattttctgtagagacggggtttcaccatgttggccaggatggtcttgatctcttgacctcgtgatccgcccacctcagcttcccaaagtgctgggaggattacaggcatgagccaccatgcctggc

SEQ ID NO: 147665 - DNA, 319 bp, Homo sapiens
  Payload ID: 9217
  Gene Symbol: LGALS3
  Gene Name: lectin, galactoside-binding, soluble, 3
  ENST ID: ENST00000553493
  CDS Start-End: 54-319
aaaccaaatactcagctgcgttaggaattccttctgattcttgctgcaggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccctggagcacctggagcttatcccggagcacctgcacctggagtctacccagggccacccagcggccctggggccta

SEQ ID NO: 147666 - DNA, 2405 bp, Homo sapiens
  Payload ID: 9218
  Gene Symbol: LGALS3BP
  Gene Name: lectin, galactoside-binding, soluble, 3 binding protein
  Uniprot ID: Q08380
  ENST ID: ENST00000262776
  CDS Start-End: 310-2067
gactcccaccttgggcctctgccagcctggcactgatagccacaggcagagctgagacaaaagagaggggccctggggagtatcagcagcagccaatcccggaagacatctatgtcaggtggtttctggaaatcgaaagtagactcttttctgaagcatttcctgggatcagcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggatgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttcctacatttgtttgtacagaa

SEQ ID NO: 147667 - DNA, 1961 bp, Homo sapiens
  Payload ID: 9218
  Gene Symbol: LGALS3BP
  Gene Name: lectin, galactoside-binding, soluble, 3 binding protein
  ENST ID: ENST00000591778
  CDS Start-End: 119-736
gggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggatgaggtccagtgcacgggaaccgaggcctcactggccgactgcaagtccctgggctggctgaagagcaactgcaggcacgagagagacgctggtgtggtctgcaccaatggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttcctacatttgtttgtacagaa

SEQ ID NO: 147668 - DNA, 540 bp, Homo sapiens
  Payload ID: 9218
  Gene Symbol: LGALS3BP
  Gene Name: lectin, galactoside-binding, soluble, 3 binding protein
  ENST ID: ENST00000589906
  CDS Start-End: 109-540
tctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggatcaggccccatcatgctggatgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggacctt

SEQ ID NO: 147669 - DNA, 936 bp, Homo sapiens
  Payload ID: 9218
  Gene Symbol: LGALS3BP
  Gene Name: lectin, galactoside-binding, soluble, 3 binding protein
  ENST ID: ENST00000585407
  CDS Start-End: 136-768
tgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggatgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtgagccgtctcgtcctcaggctctggggccgccaggggctttgtcctcctcccctcttcaaaagcacagccccccacacacacacctgcacatactcatgcatgcacatgtacacacgcagtcacacatgcactcacgcagttgcacacacacgcatgctcactcccacac

SEQ ID NO: 147670 - DNA, 1736 bp, Homo sapiens
  Payload ID: 9218
  Gene Symbol: LGALS3BP
  Gene Name: lectin, galactoside-binding, soluble, 3 binding protein
  ENST ID: ENST00000586720
  CDS Start-End: 109-165
tctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtct

SEQ ID NO: 147671 - DNA, 668 bp, Homo sapiens
  Payload ID: 9218
  Gene Symbol: LGALS3BP
  Gene Name: lectin, galactoside-binding, soluble, 3 binding protein
  ENST ID: ENST00000588899
  CDS Start-End: 92-280
gtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggtgagctgagcccctgggaaataccaaaagcagaagtgtggaaggctggtgcaccctggggctgctcagagcttcaaggagatattctgcctggggcccggggcccagcggttagccagatcttctctcctgcttgaagcaccaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggatgaggtccagtgcacgggaaccgaggcctcactggccgactgcaagtccctgggctggctgaagagcaactgcaggcacgagagagacgctggtgtggtctgcaccaatggtgagcgggggcgcacctccctgcggaggccccagtgtgccctggggtcccgtggc

SEQ ID NO: 147672 - DNA, 768 bp, Homo sapiens
  Payload ID: 9218
  Gene Symbol: LGALS3BP
  Gene Name: lectin, galactoside-binding, soluble, 3 binding protein
  ENST ID: ENST00000587310
  CDS Start-End: 112-237
gcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaagcaccaggtatccccagtgatgatgacttggaggttcccgggggctcacctgggttcaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggatgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctga

SEQ ID NO: 147673 - DNA, 2091 bp, Homo sapiens
  Payload ID: 9218
  Gene Symbol: LGALS3BP
  Gene Name: lectin, galactoside-binding, soluble, 3 binding protein
  ENST ID: ENST00000587251
  CDS Start-End: 124-465
atactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggtagggcctgctgcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctct

SEQ ID NO: 147674 - DNA, 818 bp, Homo sapiens
  Payload ID: 9218
  Gene Symbol: LGALS3BP
  Gene Name: lectin, galactoside-binding, soluble, 3 binding protein
  ENST ID: ENST00000589527
  CDS Start-End: 42-818
gcctgccacacagcccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggatgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatg

SEQ ID NO: 147675 - DNA, 581 bp, Homo sapiens
  Payload ID: 9218
  Gene Symbol: LGALS3BP
  Gene Name: lectin, galactoside-binding, soluble, 3 binding protein
  ENST ID: ENST00000588205
  CDS Start-End: 26-214
aggatctgggcatccaggcacggccatgacccctccgaggctcttctgggtgtggctgctggttgcaggaacccaaggtgagctgagcccctgggaaataccaaaagcagaagtgtggaaggctggtgcaccctggggctgctcagagcttcaaggagatattctgcctggggcccggggcccagcggttagccagatcttctctcctgcttgaagcaccaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggatgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagg

SEQ ID NO: 147676 - DNA, 1905 bp, Homo sapiens
  Payload ID: 9218
  Gene Symbol: LGALS3BP
  Gene Name: lectin, galactoside-binding, soluble, 3 binding protein
  ENST ID: ENST00000587311
  CDS Start-End: 124-270
atactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgaggccttgacgcaggccgaggcctggcccagtgtccccacagacctgctccaactgctgctgcccaggagcgacctggcggtgcccagcgagctggccctactgaaggccgtggacacctggagctggggggagcgtgcctcccatgaggaggtggagggcttggtggagaagatccgcttccccatgatgctccctgaggagctctttgagctgcagttcaacctgtccctgtactggagccacgaggccctgttccagaagaagactctgcaggccctggaattccacactgtgcccttccagttgctggcccggtacaaaggcctgaacctcaccgaggatacctacaagccccggatttacacctcgcccacctggagtgcctttgtgacagacagttcctggagtgcacggaagtcacaactggtctatcagtccagacgggggcctttggtcaaatattcttctgattacttccaagccccctctgactacagatactacccctaccagtccttccagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaagggtggtgagaaccggagaaccccaggacgccctcactgcaggctcccctcctcggcttccttcctctctgcaatgaccttcaacaaccggccaccagatgtcgccctactcacctgagcgctcagcttcaagaaattactggaaggcttccactagggtccaccaggagttctcccaccacctcaccagtttccaggtggtaagcaccaggacgccctcgaggttgctctgggatccccccacagcccctggtcagtctgcccttgtcactggtctgaggtcattaaaattacattgaggttcct

SEQ ID NO: 147677 - DNA, 618 bp, Homo sapiens
  Payload ID: 9218
  Gene Symbol: LGALS3BP
  Gene Name: lectin, galactoside-binding, soluble, 3 binding protein
  ENST ID: ENST00000588990
  CDS Start-End: 128-253
ctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaagcaccaggtatccccagtgatgatgacttggaggttcccgggggctcacctgggttcaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggatgaggtccagtgcacgggaaccgaggcctcactggccgactgcaagtccctgggctggctgaagagcaactgcaggcacgagagagacgctggtgtggtctgcaccaatggtgagcgggggcgcacctccctgcggaggccccagtgtgccctggggtcccgtggcc

SEQ ID NO: 147678 - DNA, 1132 bp, Homo sapiens
  Payload ID: 9218
  Gene Symbol: LGALS3BP
  Gene Name: lectin, galactoside-binding, soluble, 3 binding protein
  ENST ID: ENST00000588198
  CDS Start-End: 148-543
ctgggatcagcctgaccacgctccatactgggagaggcttctgggtcaaaggaccagtctgcagagggatcctgtggctggaagcgaggaggctccacacggccgttgcagctaccgcagccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggatgaggtccagtgcacgggaaccgaggcctcactggccgactgcaagtccctgggctggctgaagagcaactgcaggcacgagagagacgctggtgtggtctgcaccaatggagccttccagagtgaatgaggcagccacaaatccctcactttcagatgaagacactgaccccagagagtggcagtgccccggctcctaacgcagcccacttccctcccgccccttcttagaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcaggtacttctactcccgaaggattgacatcaccctgtcgtcagtcaagtgcttccacaagctggcctctgcctatggggccaggcagctgcagggctactgcgcaagcctctttgccatcctcctcccccaggacccctcgttccagatgcccctggacctgtatgcctatgcagtggccacaggggacgccctgctggagaagctctgcctacagttcctggcctggaacttcgag

SEQ ID NO: 147679 - DNA, 379 bp, Homo sapiens
  Payload ID: 9218
  Gene Symbol: LGALS3BP
  Gene Name: lectin, galactoside-binding, soluble, 3 binding protein
  ENST ID: ENST00000591274
  CDS Start-End: 114-379
gttgcagctaccgcagccagggggtgcccccagcccacgcttcatctagccaagtgttacacatccttccaggaccacactgcagaccaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctgga

SEQ ID NO: 147680 - DNA, 893 bp, Homo sapiens
  Payload ID: 9218
  Gene Symbol: LGALS3BP
  Gene Name: lectin, galactoside-binding, soluble, 3 binding protein
  ENST ID: ENST00000589775
  CDS Start-End: 265-893
atactgggagaggcttctgggtcaaaggaccagtctgcagagggatcctgtggctggaagcgaggaggctccacacggccgttgcagctaccgcagccagtagagacagggtttcgccatcttggccaggctggtctcaaactcctgacctctggtgatccacccgcctcggcctcccaaagtgtagggattacaggtgtgagccaccgcgcccggccagggcacccctctctctacacaggatctgggcatccaggcacggccatgacccctccgaggctcttctgggtgtggctgctggttgcaggaacccaaggcgtgaacgatggtgacatgcggctggccgatgggggcgccaccaaccagggccgcgtggagatcttctacagaggccagtggggcactgtgtgtgacaacctgtgggacctgactgatgccagcgtcgtctgccgggccctgggcttcgagaacgccacccaggctctgggcagagctgccttcgggcaaggatcaggccccatcatgctggatgaggtccagtgcacgggaaccgaggcctcactggccgactgcaagtccctgggctggctgaagagcaactgcaggcacgagagagacgctggtgtggtctgcaccaatgaaaccaggagcacccacaccctggacctctccagggagctctcggaggcccttggccagatctttgacagccagcggggctgcgacctgtccatcagcgtgaatgtgcagggcgaggacgccctgggcttctgtggccacacggtcatcctgactgccaacctggaggcccaggccctgtggaaggagccgggcagcaatgtcaccatgagtgtggatgctgagtgtgtgcccatggtcagggaccttctcag

SEQ ID NO: 147681 - DNA, 1535 bp, Homo sapiens
  Payload ID: 9219
  Gene Symbol: LGALS4
  Gene Name: lectin, galactoside-binding, soluble, 4
  Uniprot ID: P56470
  ENST ID: ENST00000307751
  CDS Start-End: 479-1450
acgcaatcaacgtaggtcccttcacagttgctgggagaggcaggaatttgcagttcctccgcgttctcctcctccgctgcccacctgtcctgggtcattcctgcagcctgccctgccctgcctggtctcaccctccctctgccaacagaagtctgggcagggttttatgggctctgataaggccctggcagggccgaagttcatgagcacttcctctttgcaggagggcgtaggggaggggacccaggtgatttgggtcctggctggtcaccagggaagctggcaagggaagggagactagggtgcgctctaggagaagccgacagcctgagagtcccagaagaggagccctgtggaccctcccctgccagccactcccttaccctgggtataagagccaccaccgcctgccatccgccaccatctcccactcctgcagctcttctcacaggaccagccactagcgcagcctcgagcgatggcctatgtccccgcaccgggctaccagcccacctacaacccgacgctgccttactaccagcccatcccgggcgggctcaacgtgggaatgtctgtttacatccaaggagtggccagcgagcacatgaagcggttcttcgtgaactttgtggttgggcaggatccgggctcagacgtcgccttccacttcaatccgcggtttgacggctgggacaaggtggtcttcaacacgttgcagggcgggaagtggggcagcgaggagaggaagaggagcatgcccttcaaaaagggtgccgcctttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctggtcccggacattgccatcaacagctgaacagcctgcccaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggtg

SEQ ID NO: 147682 - DNA, 661 bp, Homo sapiens
  Payload ID: 9219
  Gene Symbol: LGALS4
  Gene Name: lectin, galactoside-binding, soluble, 4
  ENST ID: ENST00000600070
  CDS Start-End: 1-656
tgcccttcaaaaagggtgccgcctttgagctggtcttcatagtcctggctgagcactacaaggtggtggtaaatggaaatcccttctatgagtacgggcaccggcttcccctacagatggtcacccacctgcaagtggatggggatctgcaacttcaatcaatcaacttcatcggaggccagcccctccggccccagggacccccgatgatgccaccttaccctaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctat

SEQ ID NO: 147683 - DNA, 691 bp, Homo sapiens
  Payload ID: 9219
  Gene Symbol: LGALS4
  Gene Name: lectin, galactoside-binding, soluble, 4
  ENST ID: ENST00000595291
  CDS Start-End: 1-117
aacttcaatcaatcaacttcatcggaggccagcccctccggccccagaggggttgcagcccaaggtgtactaacccagcacctagagaaacgccggagtctaatgggtgtgtcatagatatctgtcgactcttggagaataatatcgcttcttcctcacttcacagaccatggaaggacccccaaccttcaacccgcctgtgccatatttcgggaggctgcaaggagggctcacagctcgaagaaccatcatcatcaagggctatgtgcctcccacaggcaagagctttgctatcaacttcaaggtgggctcctcaggggacatagctctgcacattaatccccgcatgggcaacggtaccgtggtccggaacagccttctgaatggctcgtggggatccgaggagaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactcctttctaagcccctaataaaatgtctgagggtgtctcatga

SEQ ID NO: 147684 - DNA, 566 bp, Homo sapiens
  Payload ID: 9219
  Gene Symbol: LGALS4
  Gene Name: lectin, galactoside-binding, soluble, 4
  ENST ID: ENST00000594209
  CDS Start-End: 472-566
accatctcccactcctgcagctcttctcacaggaccagccactagcgcagcctcgagcgatggcctatgtccccgcaccgggctaccagcccacctacaacccggtgagatgccagctcaggccccactccgcccgcagctccgtccataagccctcacaccaattttccccactctgatcctggggggccccatctgactctgtggtctgatttacccaaagctgaccccgaccctcgatttactcctaccctgacctcaggctgtctgtgtccacgtctaactgttggccctcgtcatcttcaacctggtcctcccccatggtttcctctctcctgcttaagggactggggggcttttctgggaggggtaaaggctgcaacaggcagatggcttgtgagtcccctcaccaggcctcttctccagacgctgccttactaccagcccatcccgggcgggctcaacgtgggaatgtctgtttacatccaaggagtggccagcgagcacatgaagcggttcttcgtgaactttgtggttgggcaggatccgggctcagacgtcgcctt

SEQ ID NO: 147685 - DNA, 566 bp, Homo sapiens; identical to SEQ ID NO: 147684
  Payload ID: 9219
  Gene Symbol: LGALS4
  Gene Name: Lectin, galactoside-binding, soluble, 4
  ENST ID: ENST00000634874
  CDS Start-End: 472-566

SEQ ID NO: 147686 - DNA, 691 bp, Homo sapiens; identical to SEQ ID NO: 147683
  Payload ID: 9219
  Gene Symbol: LGALS4
  Gene Name: Lectin, galactoside-binding, soluble, 4
  ENST ID: ENST00000634958
  CDS Start-End: 1-117

SEQ ID NO: 147687 - DNA, 661 bp, Homo sapiens; identical to SEQ ID NO: 147682
  Payload ID: 9219
  Gene Symbol: LGALS4
  Gene Name: Lectin, galactoside-binding, soluble, 4
  ENST ID: ENST00000635267
  CDS Start-End: 1-656

SEQ ID NO: 147688 - DNA, 1535 bp, Homo sapiens; identical to SEQ ID NO: 147681
  Payload ID: 9219
  Gene Symbol: LGALS4
  Gene Name: Lectin, galactoside-binding, soluble, 4
  ENST ID: ENST00000634573
  CDS Start-End: 479-1450

SEQ ID NO: 147689 - DNA, 466 bp, Homo sapiens
  Payload ID: 9220
  Gene Symbol: LGALS7
  Gene Name: lectin, galactoside-binding, soluble, 7
  Uniprot ID: P47929
  ENST ID: ENST00000378626
  CDS Start-End: 1-411
atgtccaacgtcccccacaagtcctcactgcccgagggcatccgccctggcacggtgctgagaattcgcggcttggttcctcccaatgccagcaggttccatgtaaacctgctgtgcggggaggagcagggctccgatgccgcgctgcatttcaacccccggctggacacgtcggaggtggtcttcaacagcaaggagcaaggctcctggggccgcgaggagcgcgggccgggcgttcctttccagcgcgggcagcccttcgaggtgctcatcatcgcgtcagacgacggcttcaaggccgtggttggggacgcccagtaccaccacttccgccaccgcctgccgctggcgcgcgtgcgcctggtggaggtgggcggggacgtgcagctggactccgtgaggatcttctgagcagaagcccaggcgggcccggggccttggctggcaaataaagcgttagcccgca

SEQ ID NO: 147690 - DNA, 565 bp, Homo sapiens
  Payload ID: 9220
  Gene Symbol: LGALS7
  Gene Name: lectin, galactoside-binding, soluble, 7
  ENST ID: ENST00000599035
  CDS Start-End: 460-565
ctctttcaaaggagcaagtgggcagtgagtgtgccacggactggcctgggctgtggcctccgggtaacccccatcccgactgtcccctctacctctttgtggcttcctctggggccctctttgaggatctttctgtttgtctttgttgctctccccatctgtttccctgtctgtttctggtctctttcctgcctctccgccaccctttcctcttccactgatttctgccagtctcagccctggtcggctcctctgaggggtgacccaccttctgcctccctccttcggtctcaccggctcacagtggcccctgcaccccactcttgcagaacgtcccccacaagtcctcactgcccgagggcatccgccctggcacggtgctgagaattcgcggcttggttcctcccaatgccagcaggttccatgtaaacctgctgtgcggggaggagcagggctccgatgccgcgctgcatttcaacccccggctggacacgtcggaggtggtcttcaacagcaaggagcaaggctcctggggccgcgaggagcgcgggccgggcgttccttt

SEQ ID NO: 147691 - DNA, 483 bp, Homo sapiens
  Payload ID: 9220
  Gene Symbol: LGALS7
  Gene Name: Lectin, galactoside-binding, soluble, 7
  ENST ID: ENST00000634448
  CDS Start-End: 17-427
caacccggtcccagccatgtccaacgtcccccacaagtcctcgctgcccgagggcatccgccctggcacggtgctgagaattcgcggcttggttcctcccaatgccagcaggttccatgtaaacctgctgtgcggggaggagcagggctccgatgccgccctgcatttcaacccccggctggacacgtcggaggtggtcttcaacagcaaggagcaaggctcctggggccgcgaggagcgcgggccgggcgttcctttccagcgcgggcagcccttcgaggtgctcatcatcgcgtcagacgacggcttcaaggccgtggttggggacgcccagtaccaccacttccgccaccgcctgccgctggcgcgcgtgcgcctggtggaggtgggcggggacgtgcagctggactccgtgaggatcttctgagcagaagcccaggcgggcccggggccttggctggcaaataaagcgttagcccgcag

SEQ ID NO: 147692 - DNA, 483 bp, Homo sapiens
  Payload ID: 9221
  Gene Symbol: LGALS7B
  Gene Name: lectin, galactoside-binding, soluble, 7B
  Uniprot ID: P47929
  ENST ID: ENST00000314980
  CDS Start-End: 17-427
caacccggtcccagccatgtccaacgtcccccacaagtcctcactgcccgagggcatccgccctggcacggtgctgagaattcgcggcttggttcctcccaatgccagcaggttccatgtaaacctgctgtgcggggaggagcagggctccgatgccgccctgcatttcaacccccggctggacacgtcggaggtggtcttcaacagcaaggagcaaggctcctggggccgcgaggagcgcgggccgggcgttcctttccagcgcgggcagcccttcgaggtgctcatcatcgcgtcagacgacggcttcaaggccgtggttggggacgcccagtaccaccacttccgccaccgcctgccgctggcgcgcgtgcgcctggtggaggtgggcggggacgtgcagctggactccgtgaggatcttctgagcagaagcccaggcgggcccggggccttggctggcaaataaagcgttagcccgcag

SEQ ID NO: 147693 - DNA, 565 bp, Homo sapiens
  Payload ID: 9221
  Gene Symbol: LGALS7B
  Gene Name: Lectin, galactoside-binding, soluble, 7B
  ENST ID: ENST00000634993
  CDS Start-End: 460-565
ctctttcaaaggagcaagtgggcagtgagtgtgccacggactggcctgggctgtggcctccgggtaacccccatcccgactgtcccctctacctctttgtggcttcctctggggccctctttgaggatctttctgtttgtctttgttgctctccccatctgtttccctgtctgtttctggtctctttcctgcctctccgccaccctttcctcttccactgatttctgccagtctcagccctggtcggctcctctgaggggtgacccaccttctgcctccctcctttggtctcaccggctcacagtggcccctgcaccccactcttgcagaacgtcccccacaagtcctcgctgcccgagggcatccgccctggcacggtgctgagaattcgcggcttggttcctcccaatgccagcaggttccatgtaaacctgctgtgcggggaggagcagggctccgatgccgccctgcatttcaacccccggctggacacgtcggaggtggtcttcaacagcaaggagcaaggctcctggggccgcgaggagcgcgggccgggcgttccttt

SEQ ID NO: 147694 - DNA, 466 bp, Homo sapiens
  Payload ID: 9221
  Gene Symbol: LGALS7B
  Gene Name: Lectin, galactoside-binding, soluble, 7B
  ENST ID: ENST00000634800
  CDS Start-End: 1-411
atgtccaacgtcccccacaagtcctcgctgcccgagggcatccgccctggcacggtgctgagaattcgcggcttggttcctcccaatgccagcaggttccatgtaaacctgctgtgcggggaggagcagggctccgatgccgccctgcatttcaacccccggctggacacgtcggaggtggtcttcaacagcaaggagcaaggctcctggggccgcgaggagcgcgggccgggcgttcctttccagcgcgggcagcccttcgaggtgctcatcatcgcgtcagacgacggcttcaaggccgtggttggggacgcccagtaccaccacttccgccaccgcctgccgctggcgcgcgtgcgcctggtggaggtgggcggggacgtgcagctggactccgtgaggatcttctgagcagaagcccaggcgggcccggggccttggctggcaaataaagcgttagcccgca

SEQ ID NO: 147695 - DNA, 819 bp, Homo sapiens
  Payload ID: 9222
  Gene Symbol: LGALS8
  Gene Name: lectin, galactoside-binding, soluble, 8
  ENST ID: ENST00000238181
  CDS Start-End: 293-819
acacagaaggcggggcgcggggagggtggggagaccacagcagtgaggcgcgcgagccgggaagtgaacgaggactgactcctgtcgcttcccgtagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggttccaaagtctggcacgccccagcttaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaa

SEQ ID NO: 147696 - DNA, 1402 bp, Homo sapiens
  Payload ID: 9222
  Gene Symbol: LGALS8
  Gene Name: lectin, galactoside-binding, soluble, 8
  Uniprot ID: O00214
  ENST ID: ENST00000352231
  CDS Start-End: 201-1280
gatcctgtagaacttcggagattggggaagataatcggaagaggtagaagacaccgtccatgacacttcctggggaagcagatgtatgtataaggatggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccatt

SEQ ID NO: 147697 - DNA, 2437 bp, Homo sapiens
  Payload ID: 9222
  Gene Symbol: LGALS8
  Gene Name: lectin, galactoside-binding, soluble, 8
  Uniprot ID: O00214
  ENST ID: ENST00000341872
  CDS Start-End: 382-1335
tggacttggatccgaggcagacgaggaagctgagaaaaccctggcgttgaccccgtggacctgggcgccccgggaaggccagcgcttggtccaggcaggcggggcctgtgcggtgaccaccctggtcctgaaaagtcccagccccgagcgccctccctcctagacctggaggcctggaacagccagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaagagctaggatatatacttggtgaaacaaaccagtatgttccctgttctcttgagcttcgactcttctgtgcgctactgctgcgcactgctttttctacaggcattacatcaactcctaaggggtcctctgggattagttatgcagatattaaatcacccgaagacactaacttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaa

SEQ ID NO: 147698 - DNA, 4369 bp, Homo sapiens
  Payload ID: 9222
  Gene Symbol: LGALS8
  Gene Name: lectin, galactoside-binding, soluble, 8
  Uniprot ID: O00214
  ENST ID: ENST00000366584
  CDS Start-End: 567-1520
tagacctggaggcctggaacagccaggtggacgtcggcccacctttcttttctttccttcccattttcctaccacctcccaccccactccgccttccgggcaaaggcagccagatccacccaggacacattctttgtccttatccctctgtgctcgtcccacagcaagccagtcgcggtccaaggctccagaggctgtgcaggaggccgagctgggtggcgatcagcggcgggtccctgtccaaaacccagcagagccgccagggacgccccagacacagaaggcggggcgcggggagggtggggagaccacagcagtgaggcgcgcgagccgggaagtgaacgaggactgactcctgtcgcttcccgtagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaagagctaggatatatacttggtgaaacaaaccagtatgttccctgttctcttgagcttcgactcttctgtgcgctactgctgcgcactgctttttctacaggcattacatcaactcctaaggggtcctctgggattagttatgcagatattaaatcacccgaagacactaacttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtgtgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatgtaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaaagaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaa

SEQ ID NO: 147699 - DNA, 1035 bp, Homo sapiens
  Payload ID: 9222
  Gene Symbol: LGALS8
  Gene Name: lectin, galactoside-binding, soluble, 8
  ENST ID: ENST00000406509
  CDS Start-End: 411-1035
ctgtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggatggagtctcgttctgttgcccaggctggagtgcagtggcacaatctcggctcacttcaacctccgtctcccaggttcaagcaattctcctgtctcagcctcctgagtagctgggactacagggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagacatttctaaaatcgcacccagaactgtctacaccaagagcaaagattcgactgtca

SEQ ID NO: 147700 - DNA, 569 bp, Homo sapiens
  Payload ID: 9222
  Gene Symbol: LGALS8
  Gene Name: lectin, galactoside-binding, soluble, 8
  ENST ID: ENST00000430527
  CDS Start-End: 206-569
gacatgatcctgtagaacttcggagattggggaagataatcggaagaggtagaagacaccgtccatgacacttcctggggaagcagatgtatgtataaggatggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggacttacaaagtacccaag

SEQ ID NO: 147701 - DNA, 846 bp, Homo sapiens
  Payload ID: 9222
  Gene Symbol: LGALS8
  Gene Name: lectin, galactoside-binding, soluble, 8
  ENST ID: ENST00000454943
  CDS Start-End: 344-846
atagttctagaagcttgtttctcccacctgaaaagactggatttgggacatgatcctgtagaacttcggagattggggaagataatcggaagaggtagaagacaccgtccatgacacttcctggggaagcagatgtatgtataaggatccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgac

SEQ ID NO: 147702 - DNA, 574 bp, Homo sapiens
  Payload ID: 9222
  Gene Symbol: LGALS8
  Gene Name: lectin, galactoside-binding, soluble, 8
  ENST ID: ENST00000434231
  CDS Start-End: 146-307
aaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccgattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagaga

SEQ ID NO: 147703 - DNA, 6281 bp, Homo sapiens
  Payload ID: 9222
  Gene Symbol: LGALS8
  Gene Name: lectin, galactoside-binding, soluble, 8
  Uniprot ID: O00214
  ENST ID: ENST00000450372
  CDS Start-End: 382-1461
tggacttggatccgaggcagacgaggaagctgagaaaaccctggcgttgaccccgtggacctgggcgccccgggaaggccagcgcttggtccaggcaggcggggcctgtgcggtgaccaccctggtcctgaaaagtcccagccccgagcgccctccctcctagacctggaggcctggaacagccagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaagagctaggatatatacttggtgaaacaaaccagtatgttccctgttctcttgagcttcgactcttctgtgcgctactgctgcgcactgctttttctacaggcattacatcaactcctaaggggtcctctgggattagttatgcagatattaaatcacccgaagacactaacttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtgtgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatgtaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaaagaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagactctatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctactgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacatgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccgcatgcaaactcaagtgtgtcaccagattttacttcattggcgctcgccagcccgccaggctggcaataaagtgcctccagccacctctggcaggtctcctcacccacagcccctgactggtcaccactataattgtatgaggggccaggacagtcgcttgggataaactcccatctcagcactgaataaaaaacattctgtgtcacaatatcctagttttggggctttaaaaacgtctaggtgttcctcacatgccttgtctataataaggaaagcaagcagtagttgggtattgttagcttttgaaacaaaagccctactggtcttctaattttggatattttaattaaagaatatctggacagtacaaagtgaattattaaaaaaccatttgtaactacctagattcaatcaggatttccttgatttgtgcaaagtaaaatattacaataaatttgatactgctacttgtataaaaacctatggtttaaaatgtgggggttcatcataatagtctcattgttagcatatcctaataaagaatttgaactaataaatcctattaataaaa

SEQ ID NO: 147704 - DNA, 6097 bp, Homo sapiens
  Payload ID: 9222
  Gene Symbol: LGALS8
  Gene Name: lectin, galactoside-binding, soluble, 8
  ENST ID: ENST00000416919
  CDS Start-End: 382-1284
tggacttggatccgaggcagacgaggaagctgagaaaaccctggcgttgaccccgtggacctgggcgccccgggaaggccagcgcttggtccaggcaggcggggcctgtgcggtgaccaccctggtcctgaaaagtcccagccccgagcgccctccctcctagacctggaggcctggaacagccagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaagagctaggatatatacttggtgaaacaaaccagtatgttccctgttctcttgagcttcgactcttctgtgcgctactgctgcgcactgctttttctacaggcattacatcaactcctaaggggtcctctgggattagttatgcagatattaaatcacccgaagacactaacttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtgtgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatgtaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaaagaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagactctatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctactgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacatgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccgcatgcaaactcaagtgtgtcaccagattttacttcattggcgctcgccagcccgccaggctggcaataaagtgcctccagccacctctggcaggtctcctcacccacagcccctgactggtcaccactataattgtatgaggggccaggacagtcgcttgggataaactcccatctcagcactgaataaaaaacattctgtgtcacaatatcctagttttggggctttaaaaacgtctaggtgttcctcacatgccttgtctataataaggaaagcaagcagtagttgggtattgttagcttttgaaacaaaagccctactggtcttctaattttggatattttaattaaagaatatctggacagtacaaagtgaattattaaaaaaccatttgtaactacctagattcaatcaggatttccttgatttgtgcaaagtaaaatattacaataaatttgatactgctacttgtataaaaacctatggtttaaaatgtgggggttcatcataatagtctcattgttagcatatcctaataaagaatttgaactaataaatcctatt

SEQ ID NO: 147705 - DNA, 564 bp, Homo sapiens
  Payload ID: 9222
  Gene Symbol: LGALS8
  Gene Name: lectin, galactoside-binding, soluble, 8
  ENST ID: ENST00000442397
  CDS Start-End: 160-321
acttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggttccaaagtctggcacgccccagcttgtgagtatttttgcctgggttatttcatgtggaatatttt

SEQ ID NO: 147706 - DNA, 1349 bp, Homo sapiens
  Payload ID: 9222
  Gene Symbol: LGALS8
  Gene Name: lectin, galactoside-binding, soluble, 8
  Uniprot ID: O00214
  ENST ID: ENST00000527974
  CDS Start-End: 150-1229
acctgaaaagactggatttgggacatgatcctgtagaacttcggagggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcacca

SEQ ID NO: 147707 - DNA, 903 bp, Homo sapiens
  Payload ID: 9222
  Gene Symbol: LGALS8
  Gene Name: lectin, galactoside-binding, soluble, 8
  ENST ID: ENST00000525042
  CDS Start-End: 1-903
atgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtag

SEQ ID NO: 147708 - DNA, 1855 bp, Homo sapiens
  Payload ID: 9222
  Gene Symbol: LGALS8
  Gene Name: lectin, galactoside-binding, soluble, 8
  ENST ID: ENST00000323938
  CDS Start-End: 142-1014
aacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaagagctaggatatatacttggtgaaacaaaccagtatgttccctgttctcttgagcttcgactcttctgtgcgctactgctgcgcactgctttttctacaggcattacatcaactcctaaggggtcctctgggattagttatgcagatattaaatcacccgaagacactaacttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatg

SEQ ID NO: 147709 - DNA, 6420 bp, Homo sapiens
  Payload ID: 9222
  Gene Symbol: LGALS8
  Gene Name: lectin, galactoside-binding, soluble, 8
  Uniprot ID: O00214
  ENST ID: ENST00000526589
  CDS Start-End: 521-1600
agaacttcggagattggggaagataatcggaagaggtagaagacaccgtccatgacacttcctggggaagcagatgtatgtataaggataggtgtgtactgtcaaaaagcagcgcctccaagtctcttctggcactgtctggacttggatccgaggcagacgaggaagctgagaaaaccctggcgttgaccccgtggacctgggcgccccgggaaggccagcgcttggtccaggcaggcggggcctgtgcggtgaccaccctggtcctgaaaagtcccagccccgagcgccctccctcctagacctggaggcctggaacagccagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttcctagtaatagaggaggagacatttctaaaatcgcacccagaactgtctacaccaagagcaaagattcgactgtcaatcacactttgacttgcaccaaaataccacctatgaactatgtgtcaaagaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaagagctaggatatatacttggtgaaacaaaccagtatgttccctgttctcttgagcttcgactcttctgtgcgctactgctgcgcactgctttttctacaggcattacatcaactcctaaggggtcctctgggattagttatgcagatattaaatcacccgaagacactaacttacagaagacacaactccttccccagtgatcactgtcataaccagtgctctaccgtatcccatcactgaggactgatgttgactgacatcattttctttatcgtaataaacatgtggctctattagctgcaagctttaccaagtaattggcatgacatctgagcacagaaattaaggcaaaaaaccaaagcaaaacaaatacatggtgctgaaattaacttgatgccaagcccaaggcagctgatttctgtgtatttgaacttagggcaaatcagagtctacacagacgcctacagaaagtttcaggaagaggcaagatgcattcaatttgaaagatatttatgggcaacaaagtaaggtcaggattagacttcaggcattcataaggcaggcactatcagaaagtgtacgccaactaagggacccacaaagcaggcagaggtaatgcagaaatctgttttgttcccatgaaatcaccaatcaaggcctccgttcttctaaagattagtccatcatcattagcaactgagatcaaagcactcttccactttacgtgattaaaatcaaacctgtatcagcaagttaaatggttccatttctgtgatttttctattatttgaggggagttggcagaagttccatgtatatgggatctttacaggtcagatcttgttacaggaaatttcaaaggtttgggagtggggagggaaaaaagctcagtcagtgaggatcattttatcacattagactggggcagaactctgccaggatttaggaatattttcagaacagattttagatattatttctatccatatattgaaaagaataccattgtcaatcttatttttttaaaagtactcagtgtagaaatcgctagcccttaattcttttccagcttttcatattaatgtatgcagagtctcaccaagctcaaagacactggttgggggtggagggtgccacagggaaagctgtagaaggcaagaagactcgagaatcccccagagttatttttctccataaagaccatcagagtgcttaactgagctgttggagactgtgaggcatttaggaaaaaaatagcccactcacatcattccttgtaagtcttaagttcattttcattttacgtggaggaaaaaaatttaaaaagctattagtatttattaatgaattttactgagacatttcttagaaatatgcacttctatactagcaagctctgtctctaaaatgcaagttggccttttgcttgccacatttctgcattaaacttctatattagcttcaaaggcttttaaactcaatgcgaacattctacgggatgttcttagatgcctttaaaaagggggcagatctaattttatttgaaccctcactttccaacttcaccatgacccagtactagagattagggcacttcaaagcattgaaaaaaatctactgatacttactttcttagacaagtagttcttagttaaccaccaatggaactgggttcattctgaatcctggaggagcttcctcgtgccacccagtgtttctgggccctctgtgtgagcagccaggtgtgagctgttttagaagcagcgtgttgccttcatctctcccgtttcccaaaagaacaaaggataaaggtgacagtcacactcctgggttaaaaaaagcattccagaaccacttctctttatgggcacaacaaagaaacgaaggctgaagttcgcctacccaaaatgaaaagtaggctttacagtcaaaagtacttctgttgattgctaaataacttcattttcttgaaatagagcaactttgagtgaaatctgcaacatggataccatgtatgtaagatactgctgtacagaagagttaaggcttacagtgcaaatgaggcgtcagctttgggtgctaaaattaacaagtctaatattattaccatcaatcaggaagagaataataaatgtttaaacaaacacagcagtctgtataaaaataccgtgtatcatttactctttctgcagctctatacgataggcaggagaggcttatgtggcagcacaagccaggtggggattttgtaaagaagtgataaaacatttgtaagtaatccaagtaggtgtattaaggcaccaaaagtaacatggcacccaacacccaaaaataaaaatatgaaatatgagtgtgaactctgagtagagtatgaaacaccacagaaagtcttagaaatagctctggagtggctctcccaggacagtttccagttgctgaatagtcttttggcactgatgttctacttcttcacattcatctaaaaaaaaaaaaaaaaaatcaaaattaaaatctgagtcagtccgcctgcctcggttctcattagtttaattcttaatgccttgcactttccggcaatcattcaatcaaaagagtgaaatgaagcacattaacaaagcaggaggcgccacggaccgcctccctccacaccgctccttccgccttcattccttgcccacaggcttgcactggaagctgaataagaatccccaaaactcaaacttcctagggatgccacccctttagtagctcacacctcccccctccaagagctaagaaacaaaggagaatgtacttttgtagcttagataagcaatgaatcagtaaaggactgatctacttgctccaccacccctcccttaataataacatttactgttatttcctgggcctaagactctatgttccagaactgtcacagctccccatgtcacactcactagcttgtgatctttgtcaaataactgaaatcttttaagcctctagtttcttcctttgtaaaacagagataaaatgttgtggtttttaagtgagataatccaagtaaagcacctaacatggagtagtgaatgaacatcggttgctactaaaagtggacatcctactgcatccttaatgccactaggcatttccatacaatctggggaccaaaacttcaatcatataaatgtatgaggttaattaaaaacactactgtaatctgcttgtatgatcacaaaccaccacaaaagaaaagatcgtgaagattacactgtaaacggactctcaaatgatcaggaggtggtcacttcgcaacttgctccctccacccaactcaaaacaggagctcgagcctgcctgtatttgagactggagctgcctgtatgaggactggatcaactgctagtcacgttatatccaaatctgcattatcattgggcacattttcacagaattttactgaattattccttaattgtttaatggttgggaatagtttgggaattaccttccatcaactctgctaagaaaggaatggattctggtagcaagacaatataattctcctttagtttttcagccagtgctaacacagtaatcaaagcagcaaatcgaacctgaaagggataaaagagcaaagaaataaaaagtagtgttactgtatttattatcttaagagctgtactgacttgagacaagctctaactttttaaacattagttcacatgcgtttattcacttcattatgttcattaagctttcatcttagaataccagtttcaccatttgggagctgtttgtaatatgtgcaaccttataaatagtgttttccaaactgtgtcccaggactgcaaatctttaatgtgaaatgtctttttataatctcttcctttaaaaaaaaccaataaaataaaatgccgcatgcaaactcaagtgtgtcaccagattttacttcattggcgctcgccagcccgccaggctggcaataaagtgcctccagccacctctggcaggtctcctcacccacagcccctgactggtcaccactataattgtatgaggggccaggacagtcgcttgggataaactcccatctcagcactgaataaaaaacattctgtgtcacaatatcctagttttggggctttaaaaacgtctaggtgttcctcacatgccttgtctataataaggaaagcaagcagtagttgggtattgttagcttttgaaacaaaagccctactggtcttctaattttggatattttaattaaagaatatctggacagtacaaagtgaattattaaaaaaccatttgtaactacctagattcaatcaggatttccttgatttgtgcaaagtaaaatattacaataaatttgatactgctacttgtataaaaacctatggtttaaaatgtgggggttcatcataatagtctcattgttagcatatcctaataaagaatttgaactaataaatcctattaataaaa

SEQ ID NO: 147710 - DNA, 799 bp, Homo sapiens
  Payload ID: 9222
  Gene Symbol: LGALS8
  Gene Name: lectin, galactoside-binding, soluble, 8
  ENST ID: ENST00000481485
  CDS Start-End: 481-799
attttgtctttacattttacataatttcagatacattttcctcatatcaaataattcagcattttttagtactaacatcatagtctgtaagccattcaaaaaatgtatttcacaaaataggctatctcatcctttgagctattgagatgaattaatttatactcctcctaagatccctctcgtcactaagattcttttattttatgacaaaaccatagttctagaagcttgtttctcccacctgaaaagactggatttgggacatgatcctgtagaacttcggagccgcccacggacgccagagccgggaaccctgacggcacttagctgctgacaaacaacctgctccgtggagcgcctgaaacaccagtctttggggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtga

SEQ ID NO: 147711 - DNA, 554 bp, Homo sapiens
  Payload ID: 9222
  Gene Symbol: LGALS8
  Gene Name: lectin, galactoside-binding, soluble, 8
  ENST ID: ENST00000529489
  CDS Start-End: 426-554
agatcatagggggtctggagggtgaaaaaaaagagtttggtgctcatggatggggctagtattggggtgtaggggagattaggtcaaagcaagaggattcaaaggagaaatgaattcctttagattggggaagataatcggaagaggtagaagacaccgtccatgacacttcctggggaagcagatgtatgtataaggatatggagtctcgttctgttgcccaggctggagtgcagtggcacaatctcggctcacttcaacctccgtctcccaggttcaagcaattctcctgtctcagcctcctgagtagctgggactacagggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgca

SEQ ID NO: 147712 - DNA, 1852 bp, Homo sapiens
  Payload ID: 9222
  Gene Symbol: LGALS8
  Gene Name: lectin, galactoside-binding, soluble, 8
  Uniprot ID: O00214
  ENST ID: ENST00000526634
  CDS Start-End: 264-1217
gacttcctttgaccgtacgtgaaacttaagtgatggctgcttgtgatgcatacgaagtgttcatgctggcgggacctgtccctggggatacttcgggggttgcgtgatttaatgcaagcagatggcttaaattgggtcactggcttgttattatacatgtggccagtgcctcagtttcaatccaggtaacctttaaatgaaacttgcctaaaatcttaggtcatacacagaagagactccaatcgacaagaagctggaaaagaatgatgttgtccttaaacaacctacagaatatcatctataacccggtaatcccgtttgttggcaccattcctgatcagctggatcctggaactttgattgtgatacgtgggcatgttcctagtgacgcagacagattccaggtggatctgcagaatggcagcagcatgaaacctcgagccgatgtggcctttcatttcaatcctcgtttcaaaagggccggctgcattgtttgcaatactttgataaatgaaaaatggggacgggaagagatcacctatgacacgcctttcaaaagagaaaagtcttttgagatcgtgattatggtgctgaaggacaaattccaggtggctgtaaatggaaaacatactctgctctatggccacaggatcggcccagagaaaatagacactctgggcatttatggcaaagtgaatattcactcaattggttttagcttcagctcggacttacaaagtacccaagcatctagtctggaactgacagagataagtagagaaaatgttccaaagtctggcacgccccagcttaggctgccattcgctgcaaggttgaacacccccatgggccctggacgaactgtcgtcgttaaaggagaagtgaatgcaaatgccaaaagctttaatgttgacctactagcaggaaaatcaaaggatattgctctacacttgaacccacgcctgaatattaaagcatttgtaagaaattcttttcttcaggagtcctggggagaagaagagagaaatattacctctttcccatttagtcctgggatgtactttgagatgataatttattgtgatgttagagaattcaaggttgcagtaaatggcgtacacagcctggagtacaaacacagatttaaagagctcagcagtattgacacgctggaaattaatggagacatccacttactggaagtaaggagctggtagcctacctacacagctgctacaaaaaccaaaatacagaatggcttctgtgatactggccttgctgaaacgcatctcactgtcattctattgtttatattgttaaaatgagcttgtgcaccattaggtcctgctgggtgttctcagtccttgccatgaagtatggtggtgtctagcactgaatggggaaactgggggcagcaacacttatagccagttaaagccactctgccctctctcctactttggctgactcttcaagaatgccattcaacaagtatttatggagtacctactataatacagtagctaacatgtattgagcacagattttttttggtaaaactgtgaagagctaggatatatacttggtgaaacaaaccagtatgttccctgttctcttgagcttcgactcttctgtgcgctactgctgcgcactgctttttctacaggcattacatcaactcctaaggggtcctctgggattagttatgcagatattaaatcacccgaagacactaacttacagaagacacaactccttccccagtgatcactgtcataaccagtgctctaccgtatcccatcactgaggactgatgttgactgacatcattttctttatcgtaataaacatg

SEQ ID NO: 147713 - DNA, 3018 bp, Homo sapiens
  Payload ID: 9223
  Gene Symbol: LGALS9
  Gene Name: lectin, galactoside-binding, soluble, 9
  Uniprot ID: O00182
  ENST ID: ENST00000302228
  CDS Start-End: 1469-2440
tgtttgttaaattatatgtagggacagggtcttccaacctttcccgagctggtctcaagctcctgggctgaagtgatcctcctgcctcagcctctcaaagtgctggtattataggcataagccaccacgccctgcccatttttctaagttggattattttacactccagtctgctgtgaatgagagttccagttgttgcgtatcgcaatcaatttgtgattgcctacaaatgatgtgccgtgatgaaattgtccctggtgtccgagaggatcgcaaagaatttcccttcctttctctcctttctgctccccttgtactgtctactccttaaactggtacttgatccaggaacataatggggatggacagtgcagatggcacacatggcctcagtctattggagcatctcaaaggaattagtctgcaaattctagtgcatctaggtggagcacaggaaggaagagaggtgcagactcacgtatggccctggggcacctgccatcctctcgcacccgtacagcccttacctgccagcacttaccctacccagcttgagttctgggccttctcaccagcacatcgctgggacctggtcgacttcaggtaagtttatttcatggctccctcccccacgacctgcacatgccatatgttccttcccagccccatgtcacttgaaatgttctatcatgtccaagacttctctcctcatcctaaagtgcagaaaataaggatggagaagagaaggagaagagaatcaagagagattcattgagagggaggatcagaagctcctgggcaccccatactgtagaataaaaatattcattatggtgtttttcttgcaaaatattcccctctacataattatgtttttacatgaataatataaatttaaacaggagaaatactttttgaagagtctgagaatcttcataaagttcaggcggccacgaattagctgtgtgacctggggcatgccccttagactctgagcctcagcttctctgtatgtaaaatgggttgaagccgcccttccccacaagcaccctgtgcacaggcaatgcccagccccattattttctggactccgtggccaagcatgcttaggacacacagccacatacttctgggcagtgtcatctggcaacttgctgtcatgtcagtgtggtcaagcattgtagacctctatgaaccaaatatgcttcaggcttgggttgagcacaggagagggaggagggaaaggtcactggggctgggagtgcctacttccctctgtgagtgtcaccccagtccacccagtaccatacctttctctctctggacccacttccttttgctgccggctcctccccattgaataacagccaagttgctttggtttctatttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 147714 - DNA, 1378 bp, Homo sapiens
  Payload ID: 9223
  Gene Symbol: LGALS9
  Gene Name: lectin, galactoside-binding, soluble, 9
  Uniprot ID: O00182
  ENST ID: ENST00000313648
  CDS Start-End: 119-859
tccccattgaataacagccaagttgctttggtttctatttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccct

SEQ ID NO: 147715 - DNA, 3114 bp, Homo sapiens
  Payload ID: 9223
  Gene Symbol: LGALS9
  Gene Name: lectin, galactoside-binding, soluble, 9
  Uniprot ID: O00182
  ENST ID: ENST00000395473
  CDS Start-End: 1469-2536
tgtttgttaaattatatgtagggacagggtcttccaacctttcccgagctggtctcaagctcctgggctgaagtgatcctcctgcctcagcctctcaaagtgctggtattataggcataagccaccacgccctgcccatttttctaagttggattattttacactccagtctgctgtgaatgagagttccagttgttgcgtatcgcaatcaatttgtgattgcctacaaatgatgtgccgtgatgaaattgtccctggtgtccgagaggatcgcaaagaatttcccttcctttctctcctttctgctccccttgtactgtctactccttaaactggtacttgatccaggaacataatggggatggacagtgcagatggcacacatggcctcagtctattggagcatctcaaaggaattagtctgcaaattctagtgcatctaggtggagcacaggaaggaagagaggtgcagactcacgtatggccctggggcacctgccatcctctcgcacccgtacagcccttacctgccagcacttaccctacccagcttgagttctgggccttctcaccagcacatcgctgggacctggtcgacttcaggtaagtttatttcatggctccctcccccacgacctgcacatgccatatgttccttcccagccccatgtcacttgaaatgttctatcatgtccaagacttctctcctcatcctaaagtgcagaaaataaggatggagaagagaaggagaagagaatcaagagagattcattgagagggaggatcagaagctcctgggcaccccatactgtagaataaaaatattcattatggtgtttttcttgcaaaatattcccctctacataattatgtttttacatgaataatataaatttaaacaggagaaatactttttgaagagtctgagaatcttcataaagttcaggcggccacgaattagctgtgtgacctggggcatgccccttagactctgagcctcagcttctctgtatgtaaaatgggttgaagccgcccttccccacaagcaccctgtgcacaggcaatgcccagccccattattttctggactccgtggccaagcatgcttaggacacacagccacatacttctgggcagtgtcatctggcaacttgctgtcatgtcagtgtggtcaagcattgtagacctctatgaaccaaatatgcttcaggcttgggttgagcacaggagagggaggagggaaaggtcactggggctgggagtgcctacttccctctgtgagtgtcaccccagtccacccagtaccatacctttctctctctggacccacttccttttgctgccggctcctccccattgaataacagccaagttgctttggtttctatttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacattca

SEQ ID NO: 147716 - DNA, 598 bp, Homo sapiens
  Payload ID: 9223
  Gene Symbol: LGALS9
  Gene Name: lectin, galactoside-binding, soluble, 9
  ENST ID: ENST00000577392
  CDS Start-End: 74-598
ttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagccgatgcctttcatcaccaccattctgggagggctgtacccatccaagtccatcctcctgtcaggcactgtcctgcccagt

SEQ ID NO: 147717 - DNA, 754 bp, Homo sapiens
  Payload ID: 9223
  Gene Symbol: LGALS9
  Gene Name: lectin, galactoside-binding, soluble, 9
  ENST ID: ENST00000581710
  CDS Start-End: 1-412
ctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagagggg

SEQ ID NO: 147718 - DNA, 1512 bp, Homo sapiens
  Payload ID: 9223
  Gene Symbol: LGALS9
  Gene Name: lectin, galactoside-binding, soluble, 9
  ENST ID: ENST00000467111
  CDS Start-End: 53-280
ggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaa

SEQ ID NO: 147719 - DNA, 851 bp, Homo sapiens
  Payload ID: 9223
  Gene Symbol: LGALS9
  Gene Name: lectin, galactoside-binding, soluble, 9
  ENST ID: ENST00000580779
  CDS Start-End: 100-327
aagttgctttggtttctatttctttgttaagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgaga

SEQ ID NO: 147720 - DNA, 377 bp, Homo sapiens
  Payload ID: 9223
  Gene Symbol: LGALS9
  Gene Name: lectin, galactoside-binding, soluble, 9
  ENST ID: ENST00000578944
  CDS Start-End: 1-377
cctgttcagcctgccttctccacggtgccgttctcccagcctgtctgtttcccacccaggcccagggggcgcagacaaaaaacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgagga

SEQ ID NO: 147721 - DNA, 594 bp, Homo sapiens
  Payload ID: 9223
  Gene Symbol: LGALS9
  Gene Name: lectin, galactoside-binding, soluble, 9
  ENST ID: ENST00000584661
  CDS Start-End: 250-594
aagtcgttccctctacaaaggacttcctagtgggtgtgaaaggcagcggtggccacagaggcggcggagagatggccttcagcggttcccaggctccctacctgagtccagtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctgga

SEQ ID NO: 147722 - DNA, 1243 bp, Homo sapiens
  Payload ID: 9224
  Gene Symbol: LGALS9B
  Gene Name: lectin, galactoside-binding, soluble, 9B
  Uniprot ID: Q3B8N2
  ENST ID: ENST00000324290
  CDS Start-End: 66-1133
cattccttctgcaaaggactgcctggcaggtgtgaaaggcagcggtggccacagaggcggtggagatggccttcagcggttcccaggctccctatctgagcccagccgtccccttttctgggactatccaagggggtctccaggacggatttcagatcactgtcaatggggccgttctcagctccagtggaaccaggtttgctgtggactttcagacgggcttcagtggaaacgacattgccttccacttcaaccctcggtttgaagacggagggtatgtggtgtgcaacacgaggcagaaaggaagatgggggcccgaggagaggaagatgcacatgcccttccagaaggggatgccctttgacctctgcttcctggtgcagagctcagatttcaaggtgatggtgaacgggagcctcttcgtgcagtacttccaccgcgtgcccttccaccgtgtggacaccatctccgtcaatggctctgtgcagctgtcctacatcagcttccagaatccccgcacagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagcgcctctggacagatgttctctactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacataggcggctccctggccctggggccgggggctggggtgtggggcagtcggggtcctctcatcatccccacttcccaggcccagcctttccaaccgtgcctgggatctgggctt

SEQ ID NO: 147723 - DNA, 1713 bp, Homo sapiens
  Payload ID: 9224
  Gene Symbol: LGALS9B
  Gene Name: lectin, galactoside-binding, soluble, 9B
  Uniprot ID: Q3B8N2
  ENST ID: ENST00000423676
  CDS Start-End: 65-1135
attccttctgcaaaggactgcctggcaggtgtgaaaggcagcggtggccacagaggcggtggagatggccttcagcggttcccaggctccctatctgagcccagccgtccccttttctgggactatccaagggggtctccaggacggatttcagatcactgtcaatggggccgttctcagctccagtggaaccaggtttgctgtggactttcagacgggcttcagtggaaacgacattgccttccacttcaaccctcggtttgaagacggagggtatgtggtgtgcaacacgaggcagaaaggaagatgggggcccgaggagaggaagatgcacatgcccttccagaaggggatgccctttgacctctgcttcctggtgcagagctcagatttcaaggtgatggtgaacgggagcctcttcgtgcagtacttccaccgcgtgcccttccaccgtgtggacaccatctccgtcaatggctctgtgcagctgtcctacatcagcttccagaatccccgcacagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagcgcctctggacagatgttctctcagactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacataggcggctccctggccctggggccgggggctggggtgtggggcagtcggggtcctctcatcatccccacttcccaggcccagcctttccaaccgtgcctgggatctgggctttaatgcagaggccatgtccttatctggtcctgcttctggctacagccaccctggaattgagaaggcagctgactgggattgtcttcctcagccgcagcagcacctggggcgccagctgctggaatcctacaatcccagaaggcgggcacagccagggagaggggaggagcgggcagtgaagatgaagccccatgctcagtcccctcccatcccccacgcagctccaccccagtctcaagccaccagctgtctgctcctggtgggagatggcctcctcagcccctcctctctgacctttaacctcactctcaccttgcaccctgcaccaacccttcacccctcctggaaagcaggtctgatggcttcccactggcctccaccaactgaccagagtgttctcttcaggggactggctcctttcccagtgtccttaaaataaagaaatgaaaatgcttgttggcacattca

SEQ ID NO: 147724 - DNA, 375 bp, Homo sapiens
  Payload ID: 9224
  Gene Symbol: LGALS9B
  Gene Name: lectin, galactoside-binding, soluble, 9B
  ENST ID: ENST00000584703
  CDS Start-End: 1-156
gagaggaagatgcacatgcccttccagaaggggatgccctttgacctctgcttcctggtgcagagctcagatttcaaggaacatggatggagctggaagccgttgcaggagcagaaaaccaaacaccgcaagttctcacttataagtaggagctgaacgatgagaacacatggacacaagtggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccag

SEQ ID NO: 147725 - DNA, 1115 bp, Homo sapiens
  Payload ID: 9224
  Gene Symbol: LGALS9B
  Gene Name: lectin, galactoside-binding, soluble, 9B
  ENST ID: ENST00000578481
  CDS Start-End: 70-177
aagtcattccttctgcaaaggactgcctggcaggtgtgaaaggcagcggtggccacagaggcggtggagatggccttcagcggttcccaggctccctatctgagcccagtttgctgtggactttcagacgggcttcagtggaaacgacattgccttccacttcaaccctcggtttgaagacggagggtatgtggtgtgcaacacgaggcagaaaggaagatgggggcccgaggagaggaagatgcacatgcccttccagaaggggatgccctttgacctctgcttcctggtgcagagctcagatttcaaggtgatggtgaacgggagcctcttcgtgcagtacttccaccgcgtgcccttccaccgtgtggacaccatctccgtcaatggctctgtgcagctgtcctacatcagcttccagaatccccgcacagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagcgcctctggacagatgttctctcagactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacataggcggctccctggccctggggccgggggctggggtgtggggcagtcggggtcctctcatcatccccac

SEQ ID NO: 147726 - DNA, 1730 bp, Homo sapiens
  Payload ID: 9225
  Gene Symbol: LGALS9C
  Gene Name: lectin, galactoside-binding, soluble, 9C
  Uniprot ID: Q6DKI2
  ENST ID: ENST00000328114
  CDS Start-End: 82-1152
ttactttgttaagtcattccttctgcaaaggactgcctggcaggtgtcaaaggcagtggtggccacagaggcggtggagagatggccttcagcggttgccaggctccctatctgagcccagccgtccccttttctgggactatccaagggggtctccaggacggatttcagatcactgtcaatggggccgttctcagctgcagtggaaccaggtttgctgtggactttcagacgggcttcagtggaaacgacattgccttccacttcaaccctcggtttgaagacggagggtatgtggtgtgcaacacgaggcagaaaggaacatgggggcccgaggagaggaagatgcacatgcccttccagaaggggatgccctttgacctctgcttcctggtgcagagctcagatttcaaggtgatggtgaacgggagcctcttcgtgcagtacttccaccgcgtgcccttccaccgtgtggacaccatctccgtcaatggctctgtgcagctgtcctacatcagcttccagaatccccgcgcagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagtgcctctggacagatgttctctcagactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacataggcggctccctggccctggggccgggggctggggtgtggggcagtctgggtcctctcatcatccccacttcccaggcccagcctttccaaccgtgcctgggatctgggctttaatgcagaggccatgtccttatctggtcctgcttctggctacagccaccctggaatcgagaaggcagctgactgggattgccttcctcagccgcagcagcacctggggcgccagctgctggaatcctacaatcccagaaggcgggcacagccagggagaggggaggagtgggcagtgaagatgaagccccatgctcagtcccctcccatcccccacgcagctccaccccagtctcaagccaccagctgtctgctcctggtgggagatggcctcctcagcccctcctctctgacctttaacctcactctcaccttgcaccctgcaccaacccttcacccctcctggaaagcaggcctgatggcttcccactggcctccaccaactgaccagagtgttctcttcaggggactggctcctttcccagtgtccttaaaataaagaaatgaaaatgcttgttggcacattca

SEQ ID NO: 147727 - DNA, 1515 bp, Homo sapiens
  Payload ID: 9225
  Gene Symbol: LGALS9C
  Gene Name: lectin, galactoside-binding, soluble, 9C
  ENST ID: ENST00000580674
  CDS Start-End: 56-283
aaaggactgcctggcaggtgtcaaaggcagtggtggccacagaggcggtggagagatggccttcagcggttgccaggctccctatctgagcccagccgtccccttttctgggactatccaagggggtctccaggacggatttcagatcactgtcaatggggccgttctcagctgcagtggaaccagacggagggtatgtggtgtgcaacacgaggcagaaaggaacatgggggcccgaggagaggaagatgcacatgcccttccagaaggggatgccctttgacctctgcttcctggtgcagagctcagatttcaaggtgatggtgaacgggagcctcttcgtgcagtacttccaccgcgtgcccttccaccgtgtggacaccatctccgtcaatggctctgtgcagctgtcctacatcagcttccagcctcccagcgtgcggcctgccaacccagctcccattacccagacagtcatccacacggtgcagagtgcctctggacagatgttctctactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacataggcggctccctggccctggggccgggggctggggtgtggggcagtctgggtcctctcatcatccccacttcccaggcccagcctttccaaccgtgcctgggatctgggctttaatgcagaggccatgtccttatctggtcctgcttctggctacagccaccctggaatcgagaaggcagctgactgggattgccttcctcagccgcagcagcacctggggcgccagctgctggaatcctacaatcccagaaggcgggcacagccagggagaggggaggagtgggcagtgaagatgaagccccatgctcagtcccctcccatcccccacgcagctccaccccagtctcaagccaccagctgtctgctcctggtgggagatggcctcctcagcccctcctctctgacctttaacctcactctcaccttgcaccctgcaccaacccttcacccctcctggaaagcaggcctgatggcttcccactggcctccaccaactgaccagagtgttctcttcaggggactggctcctttcccagtgtccttaaaataaagaaatgaaa

SEQ ID NO: 147728 - DNA, 381 bp, Homo sapiens
  Payload ID: 9225
  Gene Symbol: LGALS9C
  Gene Name: lectin, galactoside-binding, soluble, 9C
  ENST ID: ENST00000578563
  CDS Start-End: 1-162
cccgaggagaggaagatgcacatgcccttccagaaggggatgccctttgacctctgcttcctggtgcagagctcagatttcaaggaacatggatggagctggaagccgttgcaggagcagaaaaccaaacaccgcaagttctcacttataagtaggagctgaacgatgagaacacatggacacaagcggggaaacaacacacactggggcctggtcggggacggagagcatcaggaagattagctaatggatgctgggcttgataccaaggtgatggtgaacgggagcctcttcgtgcagtacttccaccgcgtgcccttccaccgtgtggacaccatctccgtcaatggctctgtgcagctgtcctacatcagcttccag

SEQ ID NO: 147729 - DNA, 1602 bp, Homo sapiens
  Payload ID: 9225
  Gene Symbol: LGALS9C
  Gene Name: lectin, galactoside-binding, soluble, 9C
  ENST ID: ENST00000583322
  CDS Start-End: 60-1031
ctgcaaaggactgcctggcaggtgtcaaaggcagtggtggccacagaggcggtggagagatggccttcagcggttgccaggctccctatctgagcccagccgtccccttttctgggactatccaagggggtctccaggacggatttcagatcactgtcaatggggccgttctcagctgcagtggaaccaggtttgctgtggactttcagacgggcttcagtggaaacgacattgccttccacttcaaccctcggtttgaagacggagggtatgtggtgtgcaacacgaggcagaaaggaacatgggggcccgaggagaggaagatgcacatgcccttccagaaggggatgccctttgacctctgcttcctggtgcagagctcagatttcaaggtgatggtgaacgggagcctcttcgtgcagtacttccaccgcgtgcccttccaccgtgtggacaccatctccgtcaatggctctgtgcagctgtcctacatcagcttccagcctcccagcgtgcggcctgccaacccagctcccattacccagacagtcatccacacggtgcagagtgcctctggacagatgttctctactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacataggcggctccctggccctggggccgggggctggggtgtggggcagtctgggtcctctcatcatccccacttcccaggcccagcctttccaaccgtgcctgggatctgggctttaatgcagaggccatgtccttatctggtcctgcttctggctacagccaccctggaatcgagaaggcagctgactgggattgccttcctcagccgcagcagcacctggggcgccagctgctggaatcctacaatcccagaaggcgggcacagccagggagaggggaggagtgggcagtgaagatgaagccccatgctcagtcccctcccatcccccacgcagctccaccccagtctcaagccaccagctgtctgctcctggtgggagatggcctcctcagcccctcctctctgacctttaacctcactctcaccttgcaccctgcaccaacccttcacccctcctggaaagcaggcctgatggcttcccactggcctccaccaactgaccagagtgttctcttcaggggactggctcctttcccagtgtccttaaaataaagaaatgaaaatgcttgttggc

SEQ ID NO: 147730 - DNA, 1104 bp, Homo sapiens
  Payload ID: 9225
  Gene Symbol: LGALS9C
  Gene Name: lectin, galactoside-binding, soluble, 9C
  ENST ID: ENST00000584941
  CDS Start-End: 58-762
gcaaaggactgcctggcaggtgtcaaaggcagtggtggccacagaggcggtggagagatggccttcagcggttgccaggctccctatctgagcccagccgtccccttttctgggactatccaagggggtctccaggacggatttcagatcactgtcaatggggccgttctcagctgcagtggaaccaggtttgctgtggactttcagacgggcttcagtggaaacgacattgccttccacttcaaccctcggtttgaagacggagggtatgtggtgtgcaacacgaggcagaaaggaacatgggggcccgaggagaggaagatgcacatgcccttccagaaggggatgccctttgacctctgcttcctggtgcagagctcagatttcaaggtgatggtgaacgggagcctcttcgtgcagtacttccaccgcgtgcccttccaccgtgtggacaccatctccgtcaatggctctgtgcagctgtcctacatcagcttccagacccagacagtcatccacacggtgcagagtgcctctggacagatgttctctactcccgccatcccacctatgatgtacccccaccctgcctatccgatgcctttcatcaccaccattccgggagggctgtacccatccaagtccatcatcctgtcaggcactgtcctgcccagtgctcagaggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacataggcggctccctggccctggggccgggggctggggtgtggggcagtctgggtcctctcatcatccccacttcccaggcccagcctttccaaccgtgcctgggatctgggctttaatgcagaggccatgtccttatctggtcctgcttctggctacagccaccctggaatcgagaaggcagctgactgggattgccttcctcagccgcagcagcacctggggcgccagctgctggaatcctacaatcccagaaggcgggcacagccagggagagggg

SEQ ID NO: 147731 - DNA, 1506 bp, Homo sapiens
  Payload ID: 9225
  Gene Symbol: LGALS9C
  Gene Name: lectin, galactoside-binding, soluble, 9C
  ENST ID: ENST00000577691
  CDS Start-End: 100-327
aagttgctttggtttctattactttgttaagtcattccttctgcaaaggactgcctggcaggtgtcaaaggcagtggtggccacagaggcggtggagagatggccttcagcggttgccaggctccctatctgagcccagccgtccccttttctgggactatccaagggggtctccaggacggatttcagatcactgtcaatggggccgttctcagctgcagtggaaccagacggagggtatgtggtgtgcaacacgaggcagaaaggaacatgggggcccgaggagaggaagatgcacatgcccttccagaaggggatgccctttgacctctgcttcctggtgcagagctcagatttcaaggtgatggtgaacgggagcctcttcgtgcagtacttccaccgcgtgcccttccaccgtgtggacaccatctccgtcaatggctctgtgcagctgtcctacatcagcttccagaatccccgcgcagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagtgcctctggacagatgttctctactcccgccatcccacctatgatgtacccccaccctgcctatccgatgcctttcatcaccaccattccgggagggctgtacccatccaagtccatcatcctgtcaggcactgtcctgcccagtgctcagaggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacataggcggctccctggccctggggccgggggctggggtgtggggcagtctgggtcctctcatcatccccacttcccaggcccagcctttccaaccgtgcctgggatctgggctttaatgcagaggccatgtccttatctggtcctgcttctggctacagccaccctggaatcgagaaggcagctgactgggattgccttcctcagccgcagcagcacctggggcgccagctgctggaatcctacaatcccagaaggcgggcacagccagggagaggggaggagtgggcagtgaagatgaagccccatgctcagtcccctcccatcccccacgcagctccaccccagtctcaagccaccagctgtctgctcctggtgggagatggcctcctcagcccctcctctctgacctttaacctcactctcaccttgcaccctgcaccaacccttcacccctcctggaaagcaggcctgatggcttcccactggcctccaccaactgaccagagtgttctcttcaggggactggctcctttcccagtgtccttaaaataaagaaatgaaaatgcttgttggcac

SEQ ID NO: 147732 - DNA, 1117 bp, Homo sapiens
  Payload ID: 9225
  Gene Symbol: LGALS9C
  Gene Name: lectin, galactoside-binding, soluble, 9C
  ENST ID: ENST00000579773
  CDS Start-End: 72-179
aagtcattccttctgcaaaggactgcctggcaggtgtcaaaggcagtggtggccacagaggcggtggagagatggccttcagcggttgccaggctccctatctgagcccagtttgctgtggactttcagacgggcttcagtggaaacgacattgccttccacttcaaccctcggtttgaagacggagggtatgtggtgtgcaacacgaggcagaaaggaacatgggggcccgaggagaggaagatgcacatgcccttccagaaggggatgccctttgacctctgcttcctggtgcagagctcagatttcaaggtgatggtgaacgggagcctcttcgtgcagtacttccaccgcgtgcccttccaccgtgtggacaccatctccgtcaatggctctgtgcagctgtcctacatcagcttccagaatccccgcgcagtccccgttcagcctgccttctccacggtgccgttctcccagcctgtctgtttcccacccaggcccagggggcgcagacaaaaacctcccagcgtgcggcctgccaacccagctcccattacccagacagtcatccacacggtgcagagtgcctctggacagatgttctctcagactcccgccatcccacctatgatgtacccccaccctgcctatccgatgcctttcatcaccaccattccgggagggctgtacccatccaagtccatcatcctgtcaggcactgtcctgcccagtgctcagaggttccacatcaacctgtgctctgggagccacatcgccttccacatgaacccccgttttgatgagaatgctgtggtccgtaacacccagatcaacaactcttgggggtctgaggagcgaagtctgccccgaaaaatgcccttcgtccgaggccagagcttctcggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacataggcggctccctggccctggggccgggggctggggtgtggggcagtctgggtcctctcatcatccccac

SEQ ID NO: 147733 - DNA, 1378 bp, Homo sapiens
  Payload ID: 9225
  Gene Symbol: LGALS9C
  Gene Name: lectin, galactoside-binding, soluble, 9C
  ENST ID: ENST00000581545
  CDS Start-End: 119-859
tccccattgaataacagccaagttgctttggtttctattactttgttaagtcattccttctgcaaaggactgcctggcaggtgtcaaaggcagtggtggccacagaggcggtggagagatggccttcagcggttgccaggctccctatctgagcccagccgtccccttttctgggactatccaagggggtctccaggacggatttcagatcactgtcaatggggccgttctcagctgcagtggaaccaggtttgctgtggactttcagacgggcttcagtggaaacgacattgccttccacttcaaccctcggtttgaagacggagggtatgtggtgtgcaacacgaggcagaaaggaacatgggggcccgaggagaggaagatgcacatgcccttccagaaggggatgccctttgacctctgcttcctggtgcagagctcagatttcaaggtgatggtgaacgggagcctcttcgtgcagtacttccaccgcgtgcccttccaccgtgtggacaccatctccgtcaatggctctgtgcagctgtcctacatcagcttccagcctcccagcgtgcggcctgccaacccagctcccattacccagacagtcatccacacggtgcagagtgcctctggacagatgttctctactcccgccatcccacctatgatgtacccccaccctgcctatccgatgcctttcatcaccaccattccgggagggctgtacccatccaagtccatcatcctgtcaggcactgtcctgcccagtgctcagaggtgtggatcttgtgtgaagctcactgcctcaaggtggccgtggatggtcagcacgtgtttgaatactaccatcgcctgaggaacctgcccaccatcaacaaactggaagtgggtggcgacatccagctgacccacgtgcagacataggcggctccctggccctggggccgggggctggggtgtggggcagtctgggtcctctcatcatccccacttcccaggcccagcctttccaaccgtgcctgggatctgggctttaatgcagaggccatgtccttatctggtcctgcttctggctacagccaccctggaatcgagaaggcagctgactgggattgccttcctcagccgcagcagcacctggggcgccagctgctggaatcctacaatcccagaaggcgggcacagccagggagaggggaggagtgggcagtgaagatgaagccccatgctcagtcccctcccatcccccacgcagctccaccccagtctcaagccaccagctgtctgctcctggtgggagatggcctcctcagcccctcctctctgacctttaacctcactctcaccttgcaccctgcaccaacccttcacccct

SEQ ID NO: 147734 - DNA, 615 bp, Homo sapiens
  Payload ID: 9225
  Gene Symbol: LGALS9C
  Gene Name: lectin, galactoside-binding, soluble, 9C
  ENST ID: ENST00000582333
  CDS Start-End: 91-615
tggtttctattactttgttaagtcattccttctgcaaaggactgcctggcaggtgtcaaaggcagtggtggccacagaggcggtggagagatggccttcagcggttgccaggctccctatctgagcccagccgtccccttttctgggactatccaagggggtctccaggacggatttcagatcactgtcaatggggccgttctcagctgcagtggaaccaggtttgctgtggactttcagacgggcttcagtggaaacgacattgccttccacttcaaccctcggtttgaagacggagggtatgtggtgtgcaacacgaggcagaaaggaacatgggggcccgaggagaggaagatgcacatgcccttccagaaggggatgccctttgacctctgcttcctggtgcagagctcagatttcaaggtgatggtgaacgggagcctcttcgtgcagtacttccaccgcgtgcccttccaccgtgtggacaccatctccgtcaatggctctgtgcagctgtcctacatcagcttccagccgatgcctttcatcaccaccattccgggagggctgtacccatccaagtccatcatcctgtcaggcactgtcctgcccagt

SEQ ID NO: 147735 - DNA, 3926 bp, Homo sapiens
  Payload ID: 9226
  Gene Symbol: LGALSL
  Gene Name: lectin, galactoside-binding-like
  Uniprot ID: Q3ZCW2
  ENST ID: ENST00000238875
  CDS Start-End: 455-973
gccaccgtccaatggccgaggggcagggcccgctgagcaagccgcggcagccccgccgggtccccgccctgttcccggttcccgagccgggccccggaggcctttaaatgctgcccagggccgacgcggcacggccctcgccacttttcttggtcgggcagcggcagcggcagcggcagcaagcagccccgtcggcccgggtccggggccgttctgggccgcggcaagcaccttcgccctcccagctcgcgctgcctccctcccctcccctcctcccaggctctgcctgccaggtcggcgccgggccccgggcgcgcgcgcgcgcgccccctcgtgtgtgcgcgcgcccgccgccagctcggacccgcgcccccgcccccgccccgcgcaggacagccccgggatccccgcccgcgcgccgcgtcccacgtaccccgccgcgccgggcaagaagatggcgggatcagtggccgacagcgatgccgtggtgaaactagatgatggccatttaaacaactctttgagctctccagttcaagcggacgtgtacttcccacgactgatagttccattttgtgggcacattaaaggtggcatgagaccaggcaagaaggtgttagtgatgggcatcgtagacctcaacccagagagctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcagggtggaaattctttgtgagcacccacgtttccgagtgtttgtggatggacaccaactttttgatttttaccatcgcattcaaacgttatctgcaattgacaccataaagataaatggagacctccagatcaccaagcttggctgatttaaaccacctctatttcaaataggatcacgtgccacaactatctgactgttggtctggaagaagtgtcctagcaagatctggagacttaaaaagaaaacaaaaacaaatggcaagtttcacttaagggtggtttgcccttaagaagaaagctgttgggacaaagacaccgagccattatacccagaataaaataatacatttatgctggattttattcagaccaaactaaaatggatttgtgatgatttgtgatttggtagcaaattattcatcttttcaaagcaaggcaatgcttagaaacagaagtgctaaagacacttaaaaagccaacaacaacggtacagtgaaatcaatgcatttctgcactaaagtggaattgtgtagcacaaccaatattttagtcagggtatttacatagaatgtaggttgttcaaggtttgactttttttttgttttttgtttttgtttttgtttttgttttgcacagcataatgttaattcagattgttgaagctttcttgtagttatttatttatactcaatgtatgtattaaagaatgaacaatgtctcaagaacagcaagttgtaaacttttgaatgtataaatatcttaggtccaaggggagaaaattacatattacaattatgaaacaggtgaatttctgctttaaagaattgagattctccatacccctaaacttaggatctcttgatataaactgctgtaagtgcttttgggaaacctttgcaaaaccattttgataaaactgctttccaagttattgttggttatgtaaaattctatttacattgctttttctccttactgggaattagcacattattggcttccttaagactaattatttctctcttgatttatataatagctcattaagttgttattaatcaaaaacacaaagaggtgattgcttagacaatttttaaagtgactatagtataaacttttaaaagaataatatgaaaatgactgtggaatgcagtgtaaagcagaagcaaacggccctgaataacttacttggaagtaatttatatcaacttaagctgttagctcattgtataacttttcttatgtgaccctcaccaatatccctaagtaatgcctttggaagcttcagagtagaagatgcttcctactgtgttggctctgaggagatagtaggattagataggatccagattaggaaatgatccagttagtttatctgaaaggttaactcccaggactccaggtctttgaatccagccagtagagtgaatgcttccaattaagctgtaggtgttaccctgcacttacggaactgatcaaacaggtgactccaacaggaggttgcagtactgtaaacgtcaccgcaaggcaagggatgcttaaagtcctgggttctggactttaaaagctacattggccctggagggagggacccttggcattgctttgatcaggtagtgagggaagacagggttctggggtgggggtgtatttatatataatttaggttttgtttgtacagcatactgtgtcttgtaatgacacatccttgtcctgctttccttttttgagttttttttttttttttacacaacatgcagaggcactgaagtgaccatgtcattttcaagtgtcaagaatgtagacagtgtttcagtaccaaagtctaaaataaactaaaattatgaattttttataggtgatacatttggattcttctcaactttgaaactgtttagcacagttccattgtattatataagaagacactgtatccaacaagactggctgtacattgaaaagctttatgtaccagccaacttatttaaccatattcagcctgttccgtgggggctgttctgtggttccaggtattttcaagcctgtgattaacttctcatggcttgtcacttaaaagtccctaaatttgagagacttaaagggcaccttgaaatacatttgtggagttttgatccaacttatggtggaagagccccataggaagactgttttgagtggccaaccattcccacccactgcataattcagcagaaactagaggagcagggcgtgtactgattggaattgacacgcttattctgtctacctatcagctaactcattagcagccaagcccttaggcagcttagtgtgaaaatacaatgttaactgtttgtttctctgtgaggttagtgggaaccgcttggataagcctattgggattaatctaaatgatgtgatgatttgattcaggtatagcccaaattagtaaggggctttagctgtaaactgaaaacaatattcacaccctctcctgggcctgtaaggtctaaggtgagaatttcaggatggaaaatgcaatgtaaagcttccacaggaaagtattcgggtatgtaaggtgttatttctgaccagagccctagttctgcaataaccaaaaccaaggagtataaataacaatcaggctctgggggaatagaaagcaggctttagacaatctgtccatttctacagtaaaattggagtgagtgtgtatatctacttaaaacttaatagaagtgacttctactttttgggctattccagaagtattttaaaattattatttaaaattttgaagccccatttcaaatcttgccgaccttagttcaaagccccctgagagatcacttttagaattgaggatttgttaaaatggcaagtcatttcatttgtgttaaaaagaaaatacccaaaaggaaggagggagccctgtttgccttgagataaacggccttggcattttctggcattaatgtagaaataatgttcctatgatgacatattttcaaagaaacactttcttatttactgtgtggtgtaaaatgttgctaaatgtgttgttacattatgtcactgctgaaagtaatttgcactataataaaggaattttctacaaaa

SEQ ID NO: 147736 - DNA, 3298 bp, Homo sapiens
  Payload ID: 9226
  Gene Symbol: LGALSL
  Gene Name: lectin, galactoside-binding-like
  ENST ID: ENST00000409537
  CDS Start-End: 5-307
gaagatggcgggatcagtggccgacagcgatgccgtggtgaaactagatgatggccatttaaacaactctttgagctctccagttcaagcggacgtgtacttcccacgactgatagttccattttgtgggcacattaaaggtggcatgagaccaggcaagaaggtgttagtgatgggcatcgtagacctcaacccagagaggtggaaattctttgtgagcacccacgtttccgagtgtttgtggatggacaccaactttttgatttttaccatcgcattcaaacgttatctgcaattgacaccataaagataaatggagacctccagatcaccaagcttggctgatttaaaccacctctatttcaaataggatcacgtgccacaactatctgactgttggtctggaagaagtgtcctagcaagatctggagacttaaaaagaaaacaaaaacaaatggcaagtttcacttaagggtggtttgcccttaagaagaaagctgttgggacaaagacaccgagccattatacccagaataaaataatacatttatgctggattttattcagaccaaactaaaatggatttgtgatgatttgtgatttggtagcaaattattcatcttttcaaagcaaggcaatgcttagaaacagaagtgctaaagacacttaaaaagccaacaacaacggtacagtgaaatcaatgcatttctgcactaaagtggaattgtgtagcacaaccaatattttagtcagggtatttacatagaatgtaggttgttcaaggtttgactttttttttgttttttgtttttgtttttgtttttgttttgcacagcataatgttaattcagattgttgaagctttcttgtagttatttatttatactcaatgtatgtattaaagaatgaacaatgtctcaagaacagcaagttgtaaacttttgaatgtataaatatcttaggtccaaggggagaaaattacatattacaattatgaaacaggtgaatttctgctttaaagaattgagattctccatacccctaaacttaggatctcttgatataaactgctgtaagtgcttttgggaaacctttgcaaaaccattttgataaaactgctttccaagttattgttggttatgtaaaattctatttacattgctttttctccttactgggaattagcacattattggcttccttaagactaattatttctctcttgatttatataatagctcattaagttgttattaatcaaaaacacaaagaggtgattgcttagacaatttttaaagtgactatagtataaacttttaaaagaataatatgaaaatgactgtggaatgcagtgtaaagcagaagcaaacggccctgaataacttacttggaagtaatttatatcaacttaagctgttagctcattgtataacttttcttatgtgaccctcaccaatatccctaagtaatgcctttggaagcttcagagtagaagatgcttcctactgtgttggctctgaggagatagtaggattagataggatccagattaggaaatgatccagttagtttatctgaaaggttaactcccaggactccaggtctttgaatccagccagtagagtgaatgcttccaattaagctgtaggtgttaccctgcacttacggaactgatcaaacaggtgactccaacaggaggttgcagtactgtaaacgtcaccgcaaggcaagggatgcttaaagtcctgggttctggactttaaaagctacattggccctggagggagggacccttggcattgctttgatcaggtagtgagggaagacagggttctggggtgggggtgtatttatatataatttaggttttgtttgtacagcatactgtgtcttgtaatgacacatccttgtcctgctttccttttttgagttttttttttttttttacacaacatgcagaggcactgaagtgaccatgtcattttcaagtgtcaagaatgtagacagtgtttcagtaccaaagtctaaaataaactaaaattatgaattttttataggtgatacatttggattcttctcaactttgaaactgtttagcacagttccattgtattatataagaagacactgtatccaacaagactggctgtacattgaaaagctttatgtaccagccaacttatttaaccatattcagcctgttccgtgggggctgttctgtggttccaggtattttcaagcctgtgattaacttctcatggcttgtcacttaaaagtccctaaatttgagagacttaaagggcaccttgaaatacatttgtggagttttgatccaacttatggtggaagagccccataggaagactgttttgagtggccaaccattcccacccactgcataattcagcagaaactagaggagcagggcgtgtactgattggaattgacacgcttattctgtctacctatcagctaactcattagcagccaagcccttaggcagcttagtgtgaaaatacaatgttaactgtttgtttctctgtgaggttagtgggaaccgcttggataagcctattgggattaatctaaatgatgtgatgatttgattcaggtatagcccaaattagtaaggggctttagctgtaaactgaaaacaatattcacaccctctcctgggcctgtaaggtctaaggtgagaatttcaggatggaaaatgcaatgtaaagcttccacaggaaagtattcgggtatgtaaggtgttatttctgaccagagccctagttctgcaataaccaaaaccaaggagtataaataacaatcaggctctgggggaatagaaagcaggctttagacaatctgtccatttctacagtaaaattggagtgagtgtgtatatctacttaaaacttaatagaagtgacttctactttttgggctattccagaagtattttaaaattattatttaaaattttgaagccccatttcaaatcttgccgaccttagttcaaagccccctgagagatcacttttagaattgaggatttgttaaaatggcaagtcatttcatttgtgttaaaaagaaaatacccaaaaggaaggagggagccctgtttgccttgagataaacggccttggcattttctggcattaatgtagaaataatgttcctatgatgacatattttcaaagaaacactttcttatttactgtgtggtgtaaaatgttgctaaatgtgttgttacattatgtcactgctgaaagtaatttgcactataataaaggaattttctacaaaa

SEQ ID NO: 147737 - DNA, 548 bp, Homo sapiens
  Payload ID: 9226
  Gene Symbol: LGALSL
  Gene Name: lectin, galactoside-binding-like
  ENST ID: ENST00000420552
  CDS Start-End: 26-259
gtaccccgccgcgccgggcaagaagatggcgggatcagtggccgacagcgatgccgtggtgaaactagatgatggccatttaaacaactctttgagctctccagttcaagcggacgtgtacttcccacgactgatagttccattttgtgggcacattaaaggtggcatgagaccaggcaagaaggtgttagtgatgggcatcgtagacctcaacccagagagtgggatgattttcttttcagctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcagggtggaaattctttgtgagcacccacgtttccgagtgtttgtggatggacaccaactttttgatttttaccatcgcattcaaacgttatctgcaattgacaccataaagataaatggagacctccagat

SEQ ID NO: 147738 - DNA, 607 bp, Homo sapiens
  Payload ID: 9226
  Gene Symbol: LGALSL
  Gene Name: lectin, galactoside-binding-like
  ENST ID: ENST00000464281
  CDS Start-End: 233-607
acctgaccggctcgggccctcacttctccagccccggccctgcccaccctctggccggctctgcctgccaggtcggcgccgggccccgggcgcgcgcgcgcgcgccccctcgtgtgtgcgcgcgcccgccgccagctcggacccgcgcccccgcccccgccccgcgcaggacagccccgggatccccgcccgcgcgccgcgtcccacgtaccccgccgcgccgggcaagaagatggcgggatcagtggccgacagcgatgccgtggtgaaactagatgatggccatttaaacaactctttgagctctccagttcaagcggacgtgtacttcccacgactgatagttccattttgtgggcacattaaaggtggcatgagaccaggcaagaaggtgttagtgatgggcatcgtagacctcaacccagagagctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcagg

SEQ ID NO: 147739 - DNA, 469 bp, Homo sapiens
  Payload ID: 9226
  Gene Symbol: LGALSL
  Gene Name: lectin, galactoside-binding-like
  ENST ID: ENST00000462737
  CDS Start-End: 100-261
agctcggacccgcgcccccgcccccgccccgcgcaggacagccccgggatccccgcccgcgcgccgcgtcccacgtaccccgccgcgccgggcaagaagatggcgggatcagtggccgacagcgatgccgtggtgctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcagggtggaaattctttgtgagcacccacgtttccgagtgtttgtggatggacaccaactttttgatttttaccatcgcattcaaacgttatctgcaattgacaccataaagataaatggagacctccagatcaccaagcttggctgatttaaaccacct

SEQ ID NO: 147740 - DNA, 1800 bp, Homo sapiens
  Payload ID: 9227
  Gene Symbol: LMAN2
  Gene Name: lectin, mannose-binding 2
  Uniprot ID: Q12907
  ENST ID: ENST00000303127
  CDS Start-End: 206-1276
cttggagcctctaaggagatgaaactgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaacttttttttttaccgggattataaaagaacaacaagatgaccttatttcttaactgtttcaaataaatgattaaagtattttcatacattttgcttcttgcccagcagggacaggtggcagagccgaggcttagggtctggcaccccccacagctggagacggaggctctcctggggctggtgtctcaggagcaggggtctgtgtctacagatgggctgtggcccctgcaggcagctgttgaacactggagggtcccccggaccacactggggtgggctcctgaggacgtggggaagtgattttgttttgtggtgtgtggcacgtgtggcgacggataaggcctgaactgggaaacccaggccttcctgttcaccctgagctgcttcctgagacagatgctcaagtgaggctgcaggcgcggtgtggtggggccgagtgtgaccgtttgctaaataaagtgaaatacccaacctca

SEQ ID NO: 147741 - DNA, 1149 bp, Homo sapiens
  Payload ID: 9227
  Gene Symbol: LMAN2
  Gene Name: lectin, mannose-binding 2
  ENST ID: ENST00000515209
  CDS Start-End: 1-978
atggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaagctcccccgtttcttctcccccagacaacgtggacgaccccacggggaacttccgcagcgggcccctgacggggtggcgggtgttcctgctgctgctgtgcgctctcctgggcatcgttgtctgcgccgtggtgggggccgtggtgttccagaagcggcaggagcggaacaagcgcttctactgagtggcgcctccggcggggcctgtccctgggcccaggagccaatgtgaactttttt

SEQ ID NO: 147742 - DNA, 616 bp, Homo sapiens
  Payload ID: 9227
  Gene Symbol: LMAN2
  Gene Name: lectin, mannose-binding 2
  ENST ID: ENST00000514458
  CDS Start-End: 6-616
ggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcatcgactggaccaagatcgagcccagcgtcaacttcctcaagtcgcccaaagacaacgtggacgaccccacggggaacttccgcagcgggcccctga

SEQ ID NO: 147743 - DNA, 876 bp, Homo sapiens
  Payload ID: 9227
  Gene Symbol: LMAN2
  Gene Name: lectin, mannose-binding 2
  ENST ID: ENST00000502560
  CDS Start-End: 13-876
gaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagc

SEQ ID NO: 147744 - DNA, 823 bp, Homo sapiens
  Payload ID: 9227
  Gene Symbol: LMAN2
  Gene Name: lectin, mannose-binding 2
  ENST ID: ENST00000513877
  CDS Start-End: 249-823
gactgcggatataactgacggcaacagtgaacatctcaagcgggagcattcgctcattaagccctaccaaggtgaagcccttggggcgggaatgagtgaagagtgagggcgaggctgaacagggctaggggaaggcgtgccctttctcctgagcagagcatctctgtgggtttcctgcctctggtgaggccagtcctggcgtggcctcttagcacctgtctcttcccacaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtc

SEQ ID NO: 147745 - DNA, 2397 bp, Homo sapiens
  Payload ID: 9228
  Gene Symbol: LMAN2L
  Gene Name: lectin, mannose-binding 2-like
  Uniprot ID: Q9H0V9
  ENST ID: ENST00000264963
  CDS Start-End: 24-1070
atgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaacctctgtagcctaaatgaaattcttaaaatcaccgatggaaccaaa

SEQ ID NO: 147746 - DNA, 2020 bp, Homo sapiens
  Payload ID: 9228
  Gene Symbol: LMAN2L
  Gene Name: lectin, mannose-binding 2-like
  Uniprot ID: Q9H0V9
  ENST ID: ENST00000377079
  CDS Start-End: 25-1104
gatgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagaggcccagaagaggcgatattctccaggagtccagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagct

SEQ ID NO: 147747 - DNA, 1163 bp, Homo sapiens
  Payload ID: 9228
  Gene Symbol: LMAN2L
  Gene Name: lectin, mannose-binding 2-like
  ENST ID: ENST00000434865
  CDS Start-End: 24-395
atgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccaggccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccag

SEQ ID NO: 147748 - DNA, 1061 bp, Homo sapiens
  Payload ID: 9228
  Gene Symbol: LMAN2L
  Gene Name: lectin, mannose-binding 2-like
  ENST ID: ENST00000449221
  CDS Start-End: 25-396
gatgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccaggccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagaggcccagaagaggcgatattctccaggagtccagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcag

SEQ ID NO: 147749 - DNA, 1008 bp, Homo sapiens
  Payload ID: 9228
  Gene Symbol: LMAN2L
  Gene Name: lectin, mannose-binding 2-like
  ENST ID: ENST00000440610
  CDS Start-End: 25-360
gatgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccaggccatgtttcctgagagactgggagttgcaggtgcacttcaaaatccatggacaaggaaagaagaatctgcatggggatggcttggcaatctggtacacaaaggatcggatgcagccagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttga

SEQ ID NO: 147750 - DNA, 2410 bp, Homo sapiens
  Payload ID: 9228
  Gene Symbol: LMAN2L
  Gene Name: lectin, mannose-binding 2-like
  ENST ID: ENST00000434524
  CDS Start-End: 2-325
gatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgctgcattgtcttccttgaggtatggcgacaagaagtgaatgcagtattcctggtgtggctgcactgtgattttgtacaagtccatgtttcctgagagactgggagttgcaggtgcacttcaaaatccatggacaaggaaagaagaatctgcatggggatggcttggcaatctggtacacaaaggatcggatgcagccagggcctgtgtttggaaacatggacaaatttgtggggctgggagtatttgtagacacctaccccaatgaggagaagcagcaagagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccacaaagaattaaaaactggtaacaccacaggctttctgaccatccattcgttgggttttgcatttgacccaaccctctgcctacctgaggagctttctttggaaaccaggatggaaacttcttccctgccttaccttcctttcactccattcattgtcctctctgtgtgcaacctgagctgggaaaggcatttggatgcctctctgttggggcctggggctgcagaacacacctgcgtttcactggccttcattaggtggccctagggagatggctttctgctttggatcactgttccctagcatgggtcttgggtctattggcatgtccatggccttcccaatcaagtctcttcaggccctcagtgaagtttggctaaaggttggtgtaaaaatcaagagaagcctggaagacatcatggatgccatggattagctgtgcaactgaccagctccaggtttgatcaaaccaaaagcaacatttgtcatgtggtctgaccatgtggagatgtttctggacttgctagagcctgcttagctgcatgttttgtagttacgatttttggaatcccactttgagtgctgaaagtgtaaggaagctttcttcttacaccttgggcttggatattgcccagagaagaaatttggctttttttttcttaatggacaagagacagttgctgttctcatgttccaagtctgagagcaacagaccctcatcatctgtgcctggaagagttcactgtcattgagcagcacagcctgagtgctggcctctgtcaacccttattccactgccttatttgacaaggggttacatgctgctcaccttactgccctgggattaaatcagttacaggccagagtctccttggagggcctggaactctgagtcctcctatgaa

SEQ ID NO: 147751 - DNA, 1400 bp, Homo sapiens
  Payload ID: 9228
  Gene Symbol: LMAN2L
  Gene Name: lectin, mannose-binding 2-like
  ENST ID: ENST00000446780
  CDS Start-End: 25-534
gatgaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggtcaaacgttcgagtacttgaaacgggagcactcgctgtcgaagccctaccagggtgtgggcacaggcagttcctcactgtggaatctgatgggcaatgccatggtgatgacccagtatatccgccttaccccagatatgcaaagtaaacagggtgccttgtggaaccgggtgccatgtttcctgagagactgggagttgcaggtgcacttcaaaatccatggacaaggaaagaagaatctgcatggggatggcttggcaatctggtacacaaaggatcggatgcagccaggcccagaagaggcgatattctccaggagtccagcgggtattcccctacatctcagccatggtgaacaacggctccctcagctatgatcatgagcgggatgggcggcctacagagctgggaggctgcacagccattgtccgcaatcttcattacgacaccttcctggtgattcgctacgtcaagaggcatttgacgataatgatggatattgatggcaagcatgagtggagggactgcattgaagtgcccggagtccgcctgccccgcggctactacttcggcacctcctccatcactggggatctctcagataatcatgatgtcatttccttgaagttgtttgaactgacagtggagagaaccccagaagaggaaaagctccatcgagatgtgttcttgccctcagtggacaatatgaagctgcctgagatgacagctccactgccgcccctgagtggcctggccctcttcctcatcgtctttttctccctggtgttttctgtatttgccatagtcattggtatcatactctacaacaaatggcaggaacagagccgaaagcgcttctactgagccctcctgctgccaccacttttgtgactgtcacccatgaggtatggaaggagcaggcactggcctgagcatgcagcctggagagtgttcttgtctctagcagctggttggggactatattctgtcactggagttttgaatgcagggaccccgcattcccatggttgtgcatggggacatctaactctggtctgggaagccacccaccccagggcaatgctgctgtgatgtgcctttccctgcagtccttccatgtgggagcagaggtgtgaagagaatttacgtggttgtgatgccaaaatcacagaacagaatttcatagcccaggctgccgtgttgtttgactcagaaggcccttctacttcagttttgaatccac

SEQ ID NO: 147752 - DNA, 5521 bp, Homo sapiens
  Payload ID: 9229
  Gene Symbol: LMAN1
  Gene Name: lectin, mannose-binding, 1
  Uniprot ID: P49257
  ENST ID: ENST00000251047
  CDS Start-End: 719-2251
cattatccctctcaccaaaaccaaaccaaaccaaagtcagtttcatttgaatgcactcttgccatggtttcaaaatttggaaagctcttggaattaaattttgagatgtaaaggctggctgacaaattcacagaaaccctctttccgacaccaacttataaatcctaaggcatcctacaaccccgtgggtgctggtttctagtttgcaacgctctaacatagcttggtagagctcagtgggctgggaccataagcattcgggattgtgccactgaaaaactgatgtcacatcaaaaggaacacctttcttctaatatactaaaaaggttttgtacaggctgggtccagaggtcttagggctagccaattcctgctcccaggtattctaagaagccggagaaagctccctgcaggtaaggacccatcggcgcttcccgcactctgccgcgcgggaagcgaaggttggagtcctttccccacccccggagggtgggcggggccgaaggaccgcaccgccccagacccgccccctgcgcgtggccccgcccacagctgctcctggccgtgcggccgcgcggaaagcggaggccgggggcggggctcaccccttgcccttgggggtcccccgggctctgccaatcagcgagcgccctgttggccatccgcagccatccgcgcccctccctctcccgccctcctccgcgttccagaatccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggaatgctattccaagttcagatcaaattcgagtagcaccatctttaaaaagccaaagaggctcagtgtggacaaagacaaaagcggcctttgagaactgggaagttgaggtgacatttcgagtgactggaagaggtcgaattggagctgatggcctagcaatttggtatgcagaaaatcaaggcttggagggccctgtgtttggatcagctgatctgtggaatggtgttggaatattttttgattcttttgacaatgatggaaagaaaaataatcctgctatagtaattataggcaacaatggacaaatccattatgaccatcaaaatgacggggctagtcaagctttggcaagttgccagagggacttccgcaacaaaccctatcctgtccgagcaaagattacctattaccagaacacactgacagtaatgatcaataatggctttacaccagataaaaatgattatgaattttgtgccaaagtggaaaatatgattatccctgcacaagggcattttggaatatctgctgcaactggaggtcttgcagatgaccatgatgtcctttcttttctgactttccagttgactgaacctggaaaagagccgcccacaccagataaagaaatttcggaaaaggaaaaagaaaagtatcaggaggaatttgagcactttcaacaagaattggataaaaaaaaagaggaattccagaagggccaccccgacctccaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagtaaatgaaatgaaaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatgccatcaaatgaaaagccgaaatgcccagaactaccaccatttccatcatgtttgtctacggtccacttcattatatttgttgtggtgcaaactgtattattcattggttatatcatgtataggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaa

SEQ ID NO: 147753 - DNA, 1873 bp, Homo sapiens
  Payload ID: 9230
  Gene Symbol: LMAN1L
  Gene Name: lectin, mannose-binding, 1 like
  Uniprot ID: Q9HAT1
  ENST ID: ENST00000309664
  CDS Start-End: 140-1720
agatagagggagaggacagtgccaaaacccagctcctggccagtccccagctcctccctgcctggccctatcccaggatcccctccccggcctcccagctatgatctaccccggggcccagacttcaggcgccttcacgatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggagacgccatcctgggcctggaggaagtgcggctgacgccatccatgaggaaccggagtggcgccgtgtggagcagggcctctgtccccttctctgcctgggaagtagaggtgcagatgagggtgacgggactggggcgccggggagcccagggcatggccgtgtggtacacccggggcaggggccatgtaggctctgtccttggggggctggcttcgtgggacggcatcgggatcttctttgactctccggcagaggatactcaggacagtcctgccatccgtgtgctggccagcgacgggcacatcccctctgagcagcctggggatggagctagccaagggctgggctcctgtcattgggacttccggaaccggccacaccccttcagagcacggatcacctactgggggcagaggctgcgcatgtccttgaacagtggcctcactcccagtgatccaggtgagttctgtgtggatgtggggcccctgcttttggtccctggaggtttctttggggtctcagcagccaccggcaccctggcagatgatcatgatgtcctgtccttcctgaccttcagcctgagtgagcccagcccagaggttccccctcagcccttcctggagatgcagcagctccgcctggcgaggcagctggaagggctgtgggcaaggctgggcttgggcaccagggaggatgtaactccaaaatcagactctgaagctcaaggagaaggggaaaggctctttgacctggaggagacgctgggcagacaccgccggatcctgcaggctctgcggggtctctccaagcagctggcccaggctgagagacaatggaagaagcagctggggcccccaggccaagccaggcctgacggaggctgggccctggatgcttcctgccagattccatccaccccagggaggggtggccacctctccatgtcactcaataaggactctgccaaggtcggtgccctgctccatggacagtggactctgctccaggccctgcaagagatgagggatgcagctgtccgcatggctgcagaagcccaggtctcctacctgcctgtgggcattgagcatcatttcttagagctggaccacatcctgggcctcctgcaggaggagcttcggggcccggcgaaggcagcagccaaggccccccgcccacctggccagcccccaagggcctcctcgtgcctgcagcctggcatcttcctgttctacctcctcattcagactgtaggcttcttcggctacgtgcacttcaggcaggagctgaacaagagccttcaggagtgtctgtccacaggcagccttcctctgggtcctgcaccacacacccccagggccctggggattctgaggaggcagcctctccctgccagcatgcctgcctgacccacctcagagcctgctttgcatcactgggaagcaggcagtgtcttgggtgggggcttggtcagtatcctctccgtctgggtgcccagctcccacgcacacctgagctttcggcatgctcccacctcgttaaaggtgatttccctctcccca

SEQ ID NO: 147754 - DNA, 1699 bp, Homo sapiens
  Payload ID: 9230
  Gene Symbol: LMAN1L
  Gene Name: lectin, mannose-binding, 1 like
  Uniprot ID: Q9HAT1
  ENST ID: ENST00000379709
  CDS Start-End: 3-1547
cgatgccggcggtcagtggtccaggtcccttattctgccttctcctcctgctcctggacccccacagccctgagacggggtgtcctcctctacgcaggtttgagtacaagctcagcttcaaaggcccaaggctggcattgcctggggctggaatacccttctggagccatcatggagacgccatcctgggcctggaggaagtgcggctgacgccatccatgaggaaccggagtggcgccgtgtggagcagggcctctgtccccttctctgcctgggaagtagaggtgcagatgagggtgacgggactggggcgccggggagcccagggcatggccgtgtggtacacccggggcaggggccatgtaggctctgtccttggggggctggcttcgtgggacggcatcgggatcttctttgactctccggcagaggatactcaggacagtcctgccatccgtgtgctggccagcgacgggcacatcccctctgagcagcctggggatggagctagccaagggctgggctcctgtcattgggacttccggaaccggccacaccccttcagagcacggatcacctactgggggcagaggctgcgcatgtccttgaacagtggcctcactcccagtgatccaggtgagttctgtgtggatgtggggcccctgcttttggtccctggaggtttctttggggtctcagcagccaccggcaccctggcaggtgaggatcccactggacaggttccccctcagcccttcctggagatgcagcagctccgcctggcgaggcagctggaagggctgtgggcaaggctgggcttgggcaccagggaggatgtaactccaaaatcagactctgaagctcaaggagaaggggaaaggctctttgacctggaggagacgctgggcagacaccgccggatcctgcaggctctgcggggtctctccaagcagctggcccaggctgagagacaatggaagaagcagctggggcccccaggccaagccaggcctgacggaggctgggccctggatgcttcctgccagattccatccaccccagggaggggtggccacctctccatgtcactcaataaggactctgccaaggtcggtgccctgctccatggacagtggactctgctccaggccctgcaagagatgagggatgcagctgtccgcatggctgcagaagcccaggtctcctacctgcctgtgggcattgagcatcatttcttagagctggaccacatcctgggcctcctgcaggaggagcttcggggcccggcgaaggcagcagccaaggccccccgcccacctggccagcccccaagggcctcctcgtgcctgcagcctggcatcttcctgttctacctcctcattcagactgtaggcttcttcggctacgtgcacttcaggcaggagctgaacaagagccttcaggagtgtctgtccacaggcagccttcctctgggtcctgcaccacacacccccagggccctggggattctgaggaggcagcctctccctgccagcatgcctgcctgacccacctcagagcctgctttgcatcactgggaagcaggcagtgtcttgggtgggggcttggtcagtatcctctccgtctgggtgcccagctcccacgcacacctgagctttcggcatgctcccacctcgttaaaggtgatttccctctcccc

SEQ ID NO: 147755 - DNA, 521 bp, Homo sapiens
  Payload ID: 9230
  Gene Symbol: LMAN1L
  Gene Name: lectin, mannose-binding, 1 like
  ENST ID: ENST00000567848
  CDS Start-End: 1-372
ctgcaggctctgcggggtctctccaagcagctggcccaggctgagagacaatggaagaagcagctggggcccccaggccaagccaggcctgacggaggctgggccctggatgcttcctgccagattccatccaccccagggaggggtggccacctctccatgtcactcaataaggactctgccaaggtcggtgccctgctccatggacagtggactctgctccaggccctgcaagagatgaggcaggagctgaacaagagccttcaggagtgtctgtccacaggcagccttcctctgggtcctgcaccacacacccccagggccctggggattctgaggaggcagcctctccctgccagcatgcctgcctgacccacctcagagcctgctttgcatcactgggaagcaggcagtgtcttgggtgggggcttggtcagtatcctctccgtctgggtgcccagctcccacgcacacctgagctttcggcatgctcccacctcgttaaaggtgatttccctctc

SEQ ID NO: 147756 - DNA, 555 bp, Homo sapiens
  Payload ID: 9230
  Gene Symbol: LMAN1L
  Gene Name: lectin, mannose-binding, 1 like
  ENST ID: ENST00000562810
  CDS Start-End: 229-555
atgatctaccccggggcccagacttcaggcgccttcacgatgccggcggtttgagtacaagctcagcttcaaaggcccaaggctggcattgcctggggctggaatacccttctggagccatcatggagacacatgctcacacactaagtcccaggcacacagaaggcaatgtggaccagcacaaacctccactctcccggctccatcccagcgggcctgtggctggccatgagaactgggggctacctggagggaagcatcctcatcccagacgccatcctgggcctggaggaagtgcggctgacgccatccatgaggaaccggagtggcgccgtgtggagcagggcctctgtccccttctctgcctgggaagtagaggtgcagatgagggtgacgggactggggcgccggggagcccagggcatggccgtgtggtacacccggggcaggggccatgtaggctctgtccttggggggctggcttcgtgggacggcatcgggatcttctttgactctccggcagaggatactcaggacagtcctgccatccgtgtg

SEQ ID NO: 147757 - DNA, 1626 bp, Homo sapiens
  Payload ID: 9231
  Gene Symbol: LEFTY1
  Gene Name: left-right determination factor 1
  Uniprot ID: O75610
  ENST ID: ENST00000272134
  CDS Start-End: 81-1181
acatccagctgcctgagaccctcctgcagccttctcaagggacagccccactctgcctcttgctcctccagggcagcaccatgcagcccctgtggctctgctgggcactctgggtgttgcccctggccagccccggggccgccctgaccggggagcagctcctgggcagcctgctgcggcagctgcagctcaaagaggtgcccaccctggacagggccgacatggaggagctggtcatccccacccacgtgagggcccagtacgtggccctgctgcagcgcagccacggggaccgctcccgcggaaagaggttcagccagagcttccgagaggtggccggcaggttcctggcgttggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccgggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggaccttggggactatggagctcagggcgactgtgaccctgaagcaccaatgaccgagggcacccgctgctgccgccaggagatgtacattgacctgcaggggatgaagtgggccgagaactgggtgctggagcccccgggcttcctggcttatgagtgtgtgggcacctgccggcagcccccggaggccctggccttcaagtggccgtttctggggcctcgacagtgcatcgcctcggagactgactcgctgcccatgatcgtcagcatcaaggagggaggcaggaccaggccccaggtggtcagcctgcccaacatgagggtgcagaagtgcagctgtgcctcggatggtgcgctcgtgccaaggaggctccagccataggcgcctagtgtagccatcgagggacttgacttgtgtgtgtttctgaagtgttcgagggtaccaggagagctggcgatgactgaactgctgatggacaaatgctctgtgctctctagtgagccctgaatttgcttcctctgacaagttacctcacctaatttttgcttctcaggaatgagaatctttggccactggagagcccttgctcagttttctctattcttattattcactgcactatattctaagcacttacatgtggagatactgtaacctgagggcagaaagcccaatgtgtcattgtttacttgtcctgtcactggatctgggctaaagtcctccaccaccactctggacctaagacctggggttaagtgtgggttgtgcatccccaatccagataataaagactttgtaaaacatgaataaaacacattttattcta

SEQ ID NO: 147758 - DNA, 512 bp, Homo sapiens
  Payload ID: 9231
  Gene Symbol: LEFTY1
  Gene Name: left-right determination factor 1
  ENST ID: ENST00000492457
  CDS Start-End: 321-512
acatagcaaagcagctcagagttggatctaggggaaagcgctggaatccacgctccgcttccccacgcagcctcgcctgtggccccagcagcgccctctgcacatgggaggtcgggcagcttagcggagctccccggccagggactcaggcctcaccaggggcccgcgtgtccagcctgacgtgggccatctgaatcgaaatacacccatcttgctcaagacgaggcctagagagtcagtcactttaacgacaggtgaccttggaggtggccggcaggttcctggcgttggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccgggcccgggtgaccgtcgagtggctgcgcgtccgcgacgacggctccaaccgcacctccctcatcgactccagg

SEQ ID NO: 147759 - DNA, 2287 bp, Homo sapiens
  Payload ID: 9232
  Gene Symbol: LEFTY2
  Gene Name: left-right determination factor 2
  Uniprot ID: O00292
  ENST ID: ENST00000366820
  CDS Start-End: 350-1450
cagggctggggtaaggccaggaaaattcaacaggcactaaaaatattgtcaagctgctgacagcacagccagaggccccaggcctgggtggcatccagacagccctgtcctttctagacagccccctcctccaggctcagggacctgtctggctgtgagctcccaggaggtcccaggggtgtgacctccctccctccctccctccctcttcccttcaccccaggccagcccagggccagctataaagctggcccagcctggctctcagcacacccagctgcctgagaccctccttcaacctccctagaggacagccccactctgcctcctgctcccccagggcagcaccatgtggcccctgtggctctgctgggcactctgggtgctgcccctggctggccccggggcggccctgaccgaggagcagctcctgggcagcctgctgcggcagctgcagctcagcgaggtgcccgtactggacagggccgacatggagaagctggtcatccccgcccacgtgagggcccagtatgtagtcctgctgcggcgcagccacggggaccgctcccgcggaaagaggttcagccagagcttccgagaggtggccggcaggttcctggcgtcggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccaggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggacctcagggactatggagctcagggcgactgtgaccctgaagcaccaatgaccgagggcacccgctgctgccgccaggagatgtacattgacctgcaggggatgaagtgggccaagaactgggtgctggagcccccgggcttcctggcttacgagtgtgtgggcacctgccagcagcccccggaggccctggccttcaattggccatttctggggccgcgacagtgtatcgcctcggagactgcctcgctgcccatgatcgtcagcatcaaggagggaggcaggaccaggccccaggtggtcagcctgcccaacatgagggtgcagaagtgcagctgtgcctcggatggggcgctcgtgccaaggaggctccagccataggcgcctggtgtatccattgagccctctaactgaacgtgtgcatagaggtggtcttaatgtaggtcttaactttatacttagcaagttactccatcccaatttagtgctcctgtgtgaccttcgccctgtgtccttccatttcctgtctttcccgtccatcacccatcctaagcacttacgtgagtaaataatgcagctcagatgctgagctctagtaggaaatgctggcatgctgattacaagatacagctgagcaatgcacacattttcagctgggagtttctgttctctggcaaattcttcactgagtctggaacaataataccctatgattagaactggggaaacagaactgaattgctgtgttatatgaggaattaaaaccttcaaatctctatttcccccaaatactgacccattctggacttttgtaaacatacctaggcccctgttcccctgagagggtgctaagaggaaggatgaagggcttcaggctgggggcagtggacagggaattgggatacctggattctggttctgacagggccacaagctaggatctctaacaaacgcagaaggctttggctcgtcatttcctcttaaaaaggaggagctgggcttcagctctaagaacttcattgccctggggatcagacagcccctacctacccctgcccactcctctggagactgagccttgcccgtgcatatttaggtcatttcccacactgtcttagagaacttgtcaccagaaaccacatgtatttgcatgttttttgttaatttagctaaagcaattgaatgtagatactcagaagaaataaaaaatgatgtttc

SEQ ID NO: 147760 - DNA, 2085 bp, Homo sapiens
  Payload ID: 9232
  Gene Symbol: LEFTY2
  Gene Name: left-right determination factor 2
  Uniprot ID: O00292
  ENST ID: ENST00000420304
  CDS Start-End: 244-1242
gtcctttctagacagccccctcctccaggctcagggacctgtctggctgtgagctcccaggaggtcccaggggtgtgacctccctccctccctccctccctcttcccttcaccccaggccagcccagggccagctataaagctggcccagcctggctctcagcacacccagctgcctgagaccctccttcaacctccctagaggacagccccactctgcctcctgctcccccagggcagcaccatgtggcccctgtggctctgctgggcactctgggtgctgcccctggctggccccggggcggccctgaccgaggagcagctcctgggcagcctgctgcggcagctgcagctcagcgaggtgcccgtactggacagggccgacatggagaagctggtcatccccgcccacgtgagggcccagtatgtagtcctgctgcggcgcagccacggggaccgctcccgcggaaagaggttcagccagagcttccgagaggtggccggcaggttcctggcgtcggaggccgcgctgcacaggcacgggcggctgtccccgcgcagcgcccaggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggacctcagggactatggagctcagggcgactgtgaccctgaagcaccaatgaccgagggcacccgctgctgccgccaggagatgtacattgacctgcaggggatgaagtgggccaagaactgggtgctggagcccccgggcttcctggcttacgagtgtgtgggcacctgccagcagcccccggaggccctggccttcaattggccatttctggggccgcgacagtgtatcgcctcggagactgcctcgctgcccatgatcgtcagcatcaaggagggaggcaggaccaggccccaggtggtcagcctgcccaacatgagggtgcagaagtgcagctgtgcctcggatggggcgctcgtgccaaggaggctccagccataggcgcctggtgtatccattgagccctctaactgaacgtgtgcatagaggtggtcttaatgtaggtcttaactttatacttagcaagttactccatcccaatttagtgctcctgtgtgaccttcgccctgtgtccttccatttcctgtctttcccgtccatcacccatcctaagcacttacgtgagtaaataatgcagctcagatgctgagctctagtaggaaatgctggcatgctgattacaagatacagctgagcaatgcacacattttcagctgggagtttctgttctctggcaaattcttcactgagtctggaacaataataccctatgattagaactggggaaacagaactgaattgctgtgttatatgaggaattaaaaccttcaaatctctatttcccccaaatactgacccattctggacttttgtaaacatacctaggcccctgttcccctgagagggtgctaagaggaaggatgaagggcttcaggctgggggcagtggacagggaattgggatacctggattctggttctgacagggccacaagctaggatctctaacaaacgcagaaggctttggctcgtcatttcctcttaaaaaggaggagctgggcttcagctctaagaacttcattgccctggggatcagacagcccctacctacccctgcccactcctctggagactgagccttgcccgtgcatatttaggtcatttcccacactgtcttagagaacttgtcaccagaaaccacatgtatttgcatgttttttgttaatttagctaaagcaattgaatgtagatactcagaagaaataaaaaatgatgtttcactctg

SEQ ID NO: 147761 - DNA, 1945 bp, Homo sapiens
  Payload ID: 9232
  Gene Symbol: LEFTY2
  Gene Name: left-right determination factor 2
  ENST ID: ENST00000616737
  CDS Start-End: 34-1152
ccactctgcctcctgctcccccagggcagcaccatgtggcccctgtggctctgctgggcactctgggtgctgcccctggctggccccggggcggccctgaccgaggagcagctcctgggcagcctgctgcggcagctgcagctcagcgaggtgcccgtactggacagggccgacatggagaagctggtcatccccgcccacgtgagggcccagtatgtagtcctgctgcggcgcagccacggggaccgctcccgcggaaagaggttcagccagagcttccgagaggtggccggcaggttcctggcgtcggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccaggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggacctcagggactatggagctcagggcgactgtgaccctgaagcaccaatgaccgagggcacccgctgctgccgccaggagatgtacattgacctgcaggggatgaagtgggccaagaactgggtgctggagcccccgggcttcctggcttacgagtgtgtgggcacctgccagcagcccccggaggccctggccttcaattggccatttctggggccgcgacagtgtatcgcctcggagactgcctcgctgcccatgatcgtcagcatcaaggagggaggcaggaccaggccccaggtggtcagcctgcccaacatgagggtgcagaagtgcagctgtgcctcggatggggcgctcgtgccaaggaggctccagcatagggcctggtgtatccattgagccctctaactgaacgtgtgcatagaggtggtcttaatgtaggtcttaactttatacttagcaagttactccatcccaatttagtgctcctgtgtgaccttcgccctgtgtccttccatttcctgtctttcccgtccatcacccatcctaagcacttacgtgagtaaataatgcagctcagatgctgagctctagtaggaaatgctggcatgctgattacaagatacagctgagcaatgcacacattttcagctgggagtttctgttctctggcaaattcttcactgagtctggaacaataataccctatgattagaactggggaaacagaactgaattgctgtgttatatgaggaattaaaaccttcaaatctctatttcccccaaatactgacccattctggacttttgtaaacatacctaggcccctgttcccctgagagggtgctaagaggaaggatgaagggcttcaggctgggggcagtggacagggaattgggatacctggattctggttctgacagggccacaagctaggatctctaacaaacgcagaaggctttggctcgtcatttcctcttaaaaaggaggagctgggcttcagctctaagaacttcattgccctggggatcagacagcccctacctacccctgcccactcctctggagactgagccttgcccgtgcatatttaggtcatttcccacactgtcttagagaacttgtcaccagaaaccacatgtatttgcatgttttttgttaatttagctaaagcaattgaatgtagatactc

SEQ ID NO: 147762 - DNA, 2055 bp, Homo sapiens
  Payload ID: 9233
  Gene Symbol: LGMN
  Gene Name: legumain
  Uniprot ID: Q99538
  ENST ID: ENST00000334869
  CDS Start-End: 244-1545
agatgccacgccccatagctccaccagtcaccgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagattcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaa

SEQ ID NO: 147763 - DNA, 2115 bp, Homo sapiens
  Payload ID: 9233
  Gene Symbol: LGMN
  Gene Name: legumain
  Uniprot ID: Q99538
  ENST ID: ENST00000393218
  CDS Start-End: 339-1640
ccagtcaccgcggcacagtggcccttaagcgaggagcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacagggtcttactctgttgcccaggctggagtgcagtggcacaatcttggctcactgcaacctctgcctcccgggttcaagcaattctcctgcctcagcctcccgagtagctgggattacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagattcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaa

SEQ ID NO: 147764 - DNA, 570 bp, Homo sapiens
  Payload ID: 9233
  Gene Symbol: LGMN
  Gene Name: legumain
  ENST ID: ENST00000554189
  CDS Start-End: 169-315
aatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccatt

SEQ ID NO: 147765 - DNA, 283 bp, Homo sapiens
  Payload ID: 9233
  Gene Symbol: LGMN
  Gene Name: legumain
  ENST ID: ENST00000553918
  CDS Start-End: 225-283
ttctcacggtcccgccggcgccaccaccgcggtcactcaccgccgccgccgccaccactgccaccacggtcgcctgccacagacagaggacagaggtctcgctctctcacccaggccggatggttcactatagccttgacttcccgggctcaagtgatcctccccgctcagccccttgagtagctgggaccacaggtgtctgcaattgaactccaaggtgcagaatggtttggaaagtagctgtattcctcagtgtggccctgggcattggtgccgttcctat

SEQ ID NO: 147766 - DNA, 533 bp, Homo sapiens
  Payload ID: 9233
  Gene Symbol: LGMN
  Gene Name: legumain
  ENST ID: ENST00000554397
  CDS Start-End: 298-533
aatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacagttttgagccagagtctcactctgccacctaggctggagtgcagtggcctgatcttggctcactgcaacctccacctcccggtttcaggcaattctcctgcctcagcctcccaagtagctgagactacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaaga

SEQ ID NO: 147767 - DNA, 573 bp, Homo sapiens
  Payload ID: 9233
  Gene Symbol: LGMN
  Gene Name: legumain
  ENST ID: ENST00000553802
  CDS Start-End: 169-573
aatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatcaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttac

SEQ ID NO: 147768 - DNA, 1832 bp, Homo sapiens
  Payload ID: 9233
  Gene Symbol: LGMN
  Gene Name: legumain
  ENST ID: ENST00000557609
  CDS Start-End: 145-498
ggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagattcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgccaggcacctcattgagaagtcagtgcgtaagatcgtctccttgctggcagcgtccgaggctgaggtggagcagctcctgtccgagagagccccgctcacggggcacagctgctacccagaggccctgctgcacttccggacccactgcttcaactggcactcccccacgtacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgtt

SEQ ID NO: 147769 - DNA, 1054 bp, Homo sapiens
  Payload ID: 9233
  Gene Symbol: LGMN
  Gene Name: legumain
  ENST ID: ENST00000556097
  CDS Start-End: 154-825
gacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatggtaggtggttggggcgccggcctcgacctgggctggcaagcaggttgctcagacaccgctgacatggaactgagcattctcctttatgcaactactgctgccaaccccagagagtcgtcctacgcctgttactatgatgagaagaggtccacgtacctgggggactggtacagcgtcaactggatggaagattcggacgtggaagatctgactaaagagaccctgcacaagcagtaccacctggtaaaatcgcacaccaacaccagccacgtcatgcagtatggaaacaaa

SEQ ID NO: 147770 - DNA, 495 bp, Homo sapiens
  Payload ID: 9233
  Gene Symbol: LGMN
  Gene Name: legumain
  ENST ID: ENST00000553371
  CDS Start-End: 324-495
aatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtggagtctcactctgttgcccaggctggagtgcagtggcacaatctcagctcactgcaaccgctgcttcccaggttcaagccattctcctgcctcagcctcccgagtagctgggattacaggtgcccaccaccacgcacaggtagcatgcccaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcacc

SEQ ID NO: 147771 - DNA, 543 bp, Homo sapiens
  Payload ID: 9233
  Gene Symbol: LGMN
  Gene Name: legumain
  ENST ID: ENST00000555169
  CDS Start-End: 1-275
atcccactccaggaattgtgatcaacaggcccaatggcacagatgtctatcagggagtcccgaaggactacactggagaggatgttaccccacaaaatttccttgctgtgttgagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttat

SEQ ID NO: 147772 - DNA, 1728 bp, Homo sapiens
  Payload ID: 9233
  Gene Symbol: LGMN
  Gene Name: legumain
  Uniprot ID: Q99538
  ENST ID: ENST00000555699
  CDS Start-End: 154-1272
gacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagattcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggatgataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaata

SEQ ID NO: 147773 - DNA, 546 bp, Homo sapiens
  Payload ID: 9233
  Gene Symbol: LGMN
  Gene Name: legumain
  ENST ID: ENST00000554919
  CDS Start-End: 311-546
aatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtggagtctcactctgttgcccaggctggagtgcagtggcacaatctcagctcactgcaaccgctgcttcccaggttcaagccattctcctgcctcagcctcccgagtagctgggattacaggtgcccaccaccacgcacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaaga

SEQ ID NO: 147774 - DNA, 588 bp, Homo sapiens
  Payload ID: 9233
  Gene Symbol: LGMN
  Gene Name: legumain
  ENST ID: ENST00000554080
  CDS Start-End: 416-588
aatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacagggtcttactctgttgcccaggctggagtgcagtggcacaatcttggctcactgcaacctctgcctcccgggttcaagcaattctcctgcctcagcctcccgagtagctgggattacagttttgagccagagtctcactctgccacctaggctggagtgcagtggcctgatcttggctcactgcaacctccacctcccggtttcaggcaattctcctgcctcagcctcccaagtagctgagactacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccg

SEQ ID NO: 147775 - DNA, 1797 bp, Homo sapiens
  Payload ID: 9233
  Gene Symbol: LGMN
  Gene Name: legumain
  Uniprot ID: Q99538
  ENST ID: ENST00000557434
  CDS Start-End: 187-1317
agcggcggcgcccgcagcaatcacagcagtgccgacgtcgtgggtgtttggtgtgaggctgcgagccgccgcgagttctcacggtcccgccggcgccaccaccgcggtcactcaccgccgccgccgccaccactgccaccacggtcgcctgccacaggtgtctgcaattgaactccaaggtgcagaatggtttggaaagtagctgtattcctcagtgtggccctgggcattggtgccgttcctatagatgatcctgaagatggaggcaagcactgggtggtgatcgtggcaggttcaaatggctggtataattataggcaccaggcagacgcgtgccatgcctaccagatcattcaccgcaatgggattcctgacgaacagatcgttgtgatgatgtacgatgacattgcttactctgaagacaatcccactccaggaattgtgatcaacaggcccaatggcacagatgtctatcagggagtcccgaaggactacactggagaggatgttaccccacaaaatttccttgctgtgttgagaggcgatgcagaagcagtgaagggcataggatccggcaaagtcctgaagagtggcccccaggatcacgtgttcatttacttcactgaccatggatctactggaatactggtttttcccaatgaagatcttcatgtaaaggacctgaatgagaccatccattacatgtacaaacacaaaatgtaccgaaagatggtgttctacattgaagcctgtgagtctgggtccatgatgaaccacctgccggataacatcaatgtttatgcaactactgctgccaaccccagagagtcgtcctacgcctgttactatgatgagaagaggtccacgtacctgggggactggtacagcgtcaactggatggaagattcggacgtggaagatctgactaaagagaccctgcacaagcagtaccacctggtaaaatcgcacaccaacaccagccacgtcatgcagtatggaaacaaaacaatctccaccatgaaagtgatgcagtttcagggtatgaaacgcaaagccagttctcccgtccccctacctccagtcacacaccttgacctcacccccagccctgatgtgcctctcaccatcatgaaaaggaaactgatgaacaccaatgatctggaggagtccaggcagctcacggaggagatccagcggcatctggattacgagtatgcgttgagacatttgtacgtgctggtcaacctttgtgagaagccgtatccgcttcacaggataaaattgtccatggaccacgtgtgccttggtcactactgaagagctgcctcctggaagcttttccaagtgtgagcgccccaccgactgtgtgctgatcagagactggagaggtggagtgagaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtctt

SEQ ID NO: 147776 - DNA, 3970 bp, Homo sapiens
  Payload ID: 9234
  Gene Symbol: LMOD1
  Gene Name: leiomodin 1 (smooth muscle)
  Uniprot ID: P29536
  ENST ID: ENST00000367288
  CDS Start-End: 248-2050
gttgtcgggtcttattggccgctgattagaccagccggggtccactagccctgggcttcagggaggctgctgcgtccagtgaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgaaagcaagcaagtggagaccaagacagatgccaagaatggagaggaaaggggcagagatgccagcaaaaaagccctgggccccagacgggactcagatctggggaaggagccaaagaggggtggtttaaagaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggagtgacaggaacacaggcttgagcagggacaaggataaaaagagagaggagatgaaggaggtggccaagaaagaggatgatgagaaggtaaaaggggagcgtaggaacacagacaccagaaaagagggtgagaagatgaaaagagcaggtgggaacacagacatgaaaaaggaggatgagaaggtaaaaagaggaactgggaacacagacaccaaaaaggacgatgaaaaagtcaagaagaatgaacccttacatgaaaaggaagccaaggatgacagcaagaccaaaacacccgagaaacagacgcccagtggccccaccaagccctctgaaggaccggccaaggtggaggaggaggcagctcccagcatatttgatgagcctctggagagagtgaagaacaatgaccccgagatgactgaggtgaacgtcaacaactcagactgcatcacaaatgagatcttggtccggtttactgaggctctggagttcaacactgtggttaagctgttcgccttggccaacacgcgagccgatgaccacgtggcctttgccattgccatcatgctcaaggccaacaagaccatcaccagcctcaacctggactccaaccacatcacaggcaaaggcatcctggccatcttccgggccctcctccagaacaacacgctgaccgagctccgcttccacaaccagcgacacatctgtggaggcaagacggagatggagatcgccaagctgctgaaggagaatactaccctgctcaagctgggctaccattttgagctggccgggccccgaatgactgtcaccaatctgctcagccgcaacatggacaagcagagacaaaagcggctgcaggagcaaaggcaggcacaggaagccaagggagagaagaaggatctgctggaggtacccaaggccggggccgtggctaagggctccccaaaaccttcacctcaaccatctccaaagccctctccaaagaactcacccaaaaaagggggtgctccagctgccccaccaccccctccccctcccttggctccaccccttatcatggagaacctgaagaattcactctcaccagctacccagaggaagatgggagacaaagtcctccctgcccaggagaagaactcccgtgaccagctattggctgccatccgctccagcaacctcaagcagctcaagaaggtggaagtgcccaaactgcttcagtaggaccaggctgccaggcaccatctgccaatgccatgactgctcaggcctcacctcccagggctacacagaccctgcccaccccatccctggctgacctgctgtggatgtccctattctgccatgggagagtccaggcctgggtcacgctcaaggaaggatgccttatctcttctcactttccttttcttgtctctgaggctctccaaattttgctttagtacatggagctcaggtttctggacaagaagagtccttttagcacatcactgagaagatggcactgtccagggcccatgtagctggcaagctgcaaaaggcctgtgatccaggaaagatgtcccacagggaccacatccaccccagccccactgccctccagggccaggattcaggcctctgaggagcccacggggcaaagctgctgggccagtggcactctgtgtgggaaaatggcagaaagatggagaggcatgggggcccaaaggggagcgtggggaggggctgaggataccccaaagtccaggctaattagaggatgtggcaggggcagtggcctggatgcacagtgcctgatgggagtaggctccagacaggaggagtgggacagacagcagctggacttgaaggtttgatgccaaagcagacattttcctcacacccacctgctgctgtatgaatagctgtgtatctgtttttccataagattttgataatatatacaaacctttagctgtgaatggctgtgccccacctgttgtcctgaactgtgagtcctgatcctaaccctgggctccctggaggactctagaagctcaggttccctgccacactatttgagttggccaagaaataaattcacatcctcagaaagtgcagcatggaggaaaatctgaactctaagcagaagactctccactgacctggttgtccaggtctagaaggccaggcctctactaggtctgctcctgaaccagtcctgctgcctggagtcagtagccagagttgttctcaggggtgctggggcagagtggagcccagggtgctgggatggctatattaggcatgttcagggatgctcattccatgactctgcctaaccatgggctcagggccaggtcctcacagcagtcacaggcccaggaaggcggcaggcagagaagtggagtgactatttggagaatagcacccatatctgtgtgccctagggctcagaggggcctcatcttccccagccctccccacctgctcaccaattccacttcctgccccaactgcaggaatgctgacaatgctgccatgcccaccatcgggtgtaggtgaaaggcatctttctgaatttcattctcttgaaggtgctgccaccccttggcactgtggaactgccaccttgggtctgtgtcacttgtaggtttctctgcctccaggttgcctcaacagcaggaggcacagcagtttcaccatctttgaggtgagggtggggtgccccagctaggaagcaagatcgctgtgctaggtctgaccaaaaccagagggcagtctagtcctgggggtaaagccctcagatcccagggtacactcttctccattccctccacccacttgcctgtcaccccagtcacctaagcaatcactgggcccagaggagaggagacagacacacactggctcctggacctaaagggtatgagctggagctaaggccagctagagcttccactgtcagccctcactgtcagtcccactgcacccccctgtgcctgctgggcactgggcactagctagatgctttaggttgcttcagctgatccttcaactctgtgaggtggataccaatattctattttgcagatagaatttggcccagagaggttaactaatatatccatgatcacacagctaataaaagtcagagctcaggtc

SEQ ID NO: 147777 - DNA, 3058 bp, Homo sapiens
  Payload ID: 9234
  Gene Symbol: LMOD1
  Gene Name: leiomodin 1 (smooth muscle)
  ENST ID: ENST00000616739
  CDS Start-End: 333-1142
agttgtcgggtcttattggccgctgattagaccagccggggtccactagccctgggcttcagggaggctgctgcgtccagtgaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgaaagcaagcaagtggagaccaagacagatgccaagaatggagaggaaaggggcagagatgccagcaaaaaagccctgggccccagacgggactcagatctggggaaggagccaaagaggggtggtttaaagaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggagtgacaggaacacaggcttgagcagggacaaggataaaaagagagaggagatgaaggaggtggccaagaaagaggatgatgagaaggtaaaagggggtgctccagctgccccaccaccccctccccctcccttggctccaccccttatcatggagaacctgaagaattcactctcaccagctacccagaggaagatgggagacaaagtcctccctgcccaggagaagaactcccgtgaccagctattggctgccatccgctccagcaacctcaagcagctcaagaaggtggaagtgcccaaactgcttcagtaggaccaggctgccaggcaccatctgccaatgccatgactgctcaggcctcacctcccagggctacacagaccctgcccaccccatccctggctgacctgctgtggatgtccctattctgccatgggagagtccaggcctgggtcacgctcaaggaaggatgccttatctcttctcactttccttttcttgtctctgaggctctccaaattttgctttagtacatggagctcaggtttctggacaagaagagtccttttagcacatcactgagaagatggcactgtccagggcccatgtagctggcaagctgcaaaaggcctgtgatccaggaaagatgtcccacagggaccacatccaccccagccccactgccctccagggccaggattcaggcctctgaggagcccacggggcaaagctgctgggccagtggcactctgtgtgggaaaatggcagaaagatggagaggcatgggggcccaaaggggagcgtggggaggggctgaggataccccaaagtccaggctaattagaggatgtggcaggggcagtggcctggatgcacagtgcctgatgggagtaggctccagacaggaggagtgggacagacagcagctggacttgaaggtttgatgccaaagcagacattttcctcacacccacctgctgctgtatgaatagctgtgtatctgtttttccataagattttgataatatatacaaacctttagctgtgaatggctgtgccccacctgttgtcctgaactgtgagtcctgatcctaaccctgggctccctggaggactctagaagctcaggttccctgccacactatttgagttggccaagaaataaattcacatcctcagaaagtgcagcatggaggaaaatctgaactctaagcagaagactctccactgacctggttgtccaggtctagaaggccaggcctctactaggtctgctcctgaaccagtcctgctgcctggagtcagtagccagagttgttctcaggggtgctggggcagagtggagcccagggtgctgggatggctatattaggcatgttcagggatgctcattccatgactctgcctaaccatgggctcagggccaggtcctcacagcagtcacaggcccaggaaggcggcaggcagagaagtggagtgactatttggagaatagcacccatatctgtgtgccctagggctcagaggggcctcatcttccccagccctccccacctgctcaccaattccacttcctgccccaactgcaggaatgctgacaatgctgccatgcccaccatcgggtgtaggtgaaaggcatctttctgaatttcattctcttgaaggtgctgccaccccttggcactgtggaactgccaccttgggtctgtgtcacttgtaggtttctctgcctccaggttgcctcaacagcaggaggcacagcagtttcaccatctttgaggtgagggtggggtgccccagctaggaagcaagatcgctgtgctaggtctgaccaaaaccagagggcagtctagtcctgggggtaaagccctcagatcccagggtacactcttctccattccctccacccacttgcctgtcaccccagtcacctaagcaatcactgggcccagaggagaggagacagacacacactggctcctggacctaaagggtatgagctggagctaaggccagctagagcttccactgtcagccctcactgtcagtcccactgcacccccctgtgcctgctgggcactgggcactagctagatgctttaggttgcttcagctgatccttcaactctgtgaggtggataccaatattctattttgcagatagaatttggcccagagaggttaactaatatatccatgatcacacagctaataaaagtcagagctca

SEQ ID NO: 147778 - DNA, 918 bp, Homo sapiens
  Payload ID: 9235
  Gene Symbol: LMOD2
  Gene Name: leiomodin 2 (cardiac)
  ENST ID: ENST00000456238
  CDS Start-End: 96-575
tgttgaccagcctgccacttgcctccctgcctgcttctggccgccttgaatgcctggtccttcaagctccttctgggtctgacaaagcagggaccatgtctacctttggctaccgaagaggactcagtaaatacgaatccatcgacgaggatgaactcctcgcctccctgtcagccgaggagctgaaggagctagagagagagttggaagacattgaacctgaccgcaaccttcccgtggggctaaggcaaaagagcctgacagagaaaacccccacagggacattcagcagagaggcactgatggcctattgggaaaaggagtcccaaaaactcttggagaaggagaggctgggggaatgtggaaaggtcaagaaacagccaaacagtattctaaaggaaataaaaaattctctgaggtcagtgcaagagaagaaaatggaagacagttcccgaccttctaccccacagagatcagctcatgagaatctcatggaagcaattcggggaagcagcataaaacagctaaagcgggtaagtaaccagagaacagacataggggcacagataaagtaaatgagttgtcctccattgcatggtggtaccaaagtcacctctcacaatacttatcaatactttcaatattttagtatgcgagagcaaacacaccaagtttgaaacattaggagcaggcacacaagtgagcacatttctatttgagaggaacgcctgggccgctttcccagcctctcaatcatataagggcaaggaccattttcatacacgtcccaattcccttaagaagaaaaccagggaatataatctaaattccaaaaggattcaccacttgtcaaaaattttaccacagagttgtgactgattcgatacctaatttataacataaaatttataatgtggt

SEQ ID NO: 147779 - DNA, 2346 bp, Homo sapiens
  Payload ID: 9235
  Gene Symbol: LMOD2
  Gene Name: leiomodin 2 (cardiac)
  Uniprot ID: Q6P5Q4
  ENST ID: ENST00000458573
  CDS Start-End: 158-1801
gcattgtcacagccctgtatcaccactcttaaaaggctcccacagccactcctagcaccagttgttgaccagcctgccacttgcctccctgcctgcttctggccgccttgaatgcctggtccttcaagctccttctgggtctgacaaagcagggaccatgtctacctttggctaccgaagaggactcagtaaatacgaatccatcgacgaggatgaactcctcgcctccctgtcagccgaggagctgaaggagctagagagagagttggaagacattgaacctgaccgcaaccttcccgtggggctaaggcaaaagagcctgacagagaaaacccccacagggacattcagcagagaggcactgatggcctattgggaaaaggagtcccaaaaactcttggagaaggagaggctgggggaatgtggaaaggttgcagaagacaaagaggaaagtgaagaagagcttatctttactgaaagtaacagtgaggtttctgaggaagtgtatacagaggaggaggaggaggagtcccaggaggaagaggaggaagaagacagtgacgaagaggaaagaacaattgaaactgcaaaagggattaatggaactgtaaattatgatagtgtcaattctgacaactctaagccaaagatatttaaaagtcaaatagagaacataaatttgaccaatggcagcaatgggaggaacacagagtccccagctgccattcacccttgtggaaatcctacagtgattgaggacgctttggacaagattaaaagcaatgaccctgacaccacagaagtcaatttgaacaacattgagaacatcacaacacagacccttacccgctttgctgaagccctcaaggacaacactgtggtgaagacgttcagtctggccaacacgcatgccgacgacagtgcagccatggccattgcagagatgctcaaagtcaatgagcacatcaccaacgtaaacgtcgagtccaacttcataacgggaaaggggatcctggccatcatgagagctctccagcacaacacggtgctcacggagctgcgtttccataaccagaggcacatcatgggcagccaggtggaaatggagattgtcaagctgctgaaggagaacacgacgctgctgaggctgggataccattttgaactcccaggaccaagaatgagcatgacgagcattttgacaagaaatatggataaacagaggcaaaaacgtttgcaggagcaaaaacagcaggagggatacgatggaggacccaatcttaggaccaaagtctggcaaagaggaacacctagctcttcaccttatgtatctcccaggcactcaccctggtcatccccaaaactccccaaaaaagtccagactgtgaggagccgtcctctgtctcctgtggccacacctcctcctcctccccctcctcctcctcctccccctccttcttcccaaaggctgccaccacctcctcctcctccccctcctccactcccagagaaaaagctcattaccagaaacattgcagaagtcatcaaacaacaggagagtgcccaacgggcattacaaaatggacaaaaaaagaaaaaagggaaaaaggtcaagaaacagccaaacagtattctaaaggaaataaaaaattctctgaggtcagtgcaagagaagaaaatggaagacagttcccgaccttctaccccacagagatcagctcatgagaatctcatggaagcaattcggggaagcagcataaaacagctaaagcgggtggaagttccagaagccctgcgataaaaacatgatctttagaagaggatgcagaactgttcagtggtattacatgaaatgcattgtgagatgtttctaaaataccttcttcaattcaaaatgatccctgactttaaaaataatctcacccattaattccaaagagaatcttaagaaacaatcagcatgtttcttctgtaaatatgaaaataaatttcttttttatgtcgtgagatttgtattggcaagaagcagttaatttaaagatgctcttcctatctgtggatgtgttggtaactccgagttgtaatgagttcatgaaatgtgctgttatttttgtaatctcaataaatgtggattgaagttttttccctttttttaaagccaaactaatatttttctgtgacttgatacatctgtcagatttttgtaatctcgataaatgtgtattgaagttttttccctttttttaaaaagccaaactaatatttttctgtgagttaatacatctgtcaggtgtgtatgtaacattactggacattaaaaaaaaatattacattctcacccaaaaa

SEQ ID NO: 147780 - DNA, 4086 bp, Homo sapiens
  Payload ID: 9236
  Gene Symbol: LMOD3
  Gene Name: leiomodin 3 (fetal)
  Uniprot ID: Q0VAK6
  ENST ID: ENST00000420581
  CDS Start-End: 181-1863
atcactcctagctgctcagcaaaccactgaggttcctgggaaaaaaaaaaaaatatctcaagggtgtgttaacttgggacactcgttaactgggggaccttcttgaggcttttttccttctttttaaaaatcatctttgattattcttcttttctagtaaaataatatttagaaaaaataatgtcagagcacagcagaaattcagatcaagaagaacttctcgatgaggagattaatgaagatgaaatcttggccaacttgtctgctgaagaactgaaagaactgcagtcggaaatggaagtcatggcccctgaccccagccttcccgtgggaatgattcagaaagatcaaactgacaagccaccgacaggaaacttcaatcataaatctcttgttgattatatgtattgggaaaaggcatccaggcgcatgctggaagaggaacgagttcctgtcacctttgtgaaatccgaggaaaagactcaagaagagcatgaagaaatagaaaaacgtaataaaaatatggcccagtatttaaaagaaaagctcaataatgaaatagttgcaaataaaagagaatcaaagggcagcagcaatatccaagaaacagatgaagaagatgaagaagaagaagatgatgatgatgacgacgaaggagaagatgatggtgaagagagtgaagaaacgaacagagaagaggaaggcaaagcaaaggaacaaattagaaattgtgagaacaactgccagcaggtaactgacaaagcattcaaagaacagagagacagaccagaggcccaagaacaaagtgagaaaaaaatatcgaaattagatcctaagaagttagctctagacaccagctttttgaaggtaagtacaaggccttcaggaaaccagacagacctggatgggagcttgaggagagttaggaaaaatgatcctgacatgaaggaactcaacctgaacaacattgaaaacatccccaaagaaatgttactggactttgtcaatgcaatgaagaaaaacaagcacatcaaaacattcagtttagccaatgtgggtgcagatgagaatgtagcatttgccttggctaacatgttgcgtgaaaatagaagcatcaccactctcaacatcgagtccaatttcatcacaggtaaagggattgtggccatcatgaggtgtctccagtttaatgagacgctaactgagcttcggtttcacaatcagaggcacatgttgggtcaccatgctgaaatggaaatagccaggcttttgaaggcaaacaacactctcctgaagatgggctaccattttgagcttccgggtcccagaatggtggtcactaatctgctcaccaggaatcaggataaacaaaggcagaaacgacaggaagagcaaaaacagcagcaactcaaggaacagaagaagctgatagccatgttagagaatgggttggggctgccccctgggatgtgggagctgttgggaggacccaagccagattccagaatgcaggaattcttccagccaccgccacctcggcctcccaacccccaaaatgtcccctttagtcaacgcagtgaaatgatgaaaaagccatcgcaggccccgaagtacaggacagaccctgactccttccgggtggtgaagctgaagagaatccagcgcaaatctcggatgccggaagccagagaaccacccgagaaaaccaacctcaaagatgtcatcaaaacgctcaagccagtgccgagaaacaggccacccccattggtggaaatcactcccagagatcagctgctaaacgacattcgtcacagcagtgtcgcctatcttaaacctgtgcaactgccaaaagaactggcgtaagaggcaacagagccatctagaagaacaagaaatggaaatagtgactcttggattacagcatggagactatgtcagcagcaatactttaggatccacgtggcagaactggaaacaatgctaccatctgataagggtatttgtaaaaggcagaatgtttgggccatgaagaagtaggggctgaagaggaaggtggaaggagataaaatataatatttagaggcaatattttctacttgcaatcaatttgagtgactcaggtgaaatttagagtcatatttcccgaagcagaagttaaagaaaattttttaaacatttgctttattattgttttcttctggtaaataataaatataacagaagtgttaactattgtattcccatttttttctccttccatctcttctgcggtaattcatcacatagtatcttaaagggaacaaataatgtttcatcctatggaaatgtgaaggatgaattgagctcctggcccttctgatgctttgaaatggaaggattgttccttagagcttctctgcagaatcagtggagattttcagtttcccaccctgcctggctttctctcttggtgactcccttggtgttttggagtattctttctataggggtacctgtgaggggcagaacacgtaagccacagaacatggtgaaaactaagtgtcactaggaaaagtaatgggaaagtaaaccctgcatatatgaaaacttcctggcagcaagttttcatatatagagggacaatgggagacagcatgctgtttttatagaaaagaagttttacataatatagttattgacaagcttttggttttggctaaatacacacacacacacacacgctcatatgtgtttactctgtaagtctaatttgattttatcactctcaaacatattttaaaggaaacttgcttacaggaaggattaaacttgaactacttatcctattctttaaggcactccattgcctggccccaatttactaatcctgtcttatttcccacaaatcctttatactctactcgatgaaacatccttgtgcacacccttgtgcctttgctcgcattaatccttccaagagacttccctcctgttctccattaatgaacgtcctacccagtcttcaactcccgggtcagatcctgtgtcctccataaaaaattttccagacaactccaatctgtccttcttccaagttcctagaggccttaattattcattctagccactaggtgcatagaatttgagatttttgtaataatagaagtagtgtgaaccctagaaattagaaaatcaagctttgggccaggtgcggtggctcatgcctgtaatcccagcactatgggaggccagggagggaggatctccagaggtcaggagttcgagaccagcctggccaacatggtgaaaccccgtctctattaaaaatacaaaaattagctgggcatgatggcaggcacctgtaatcccagctactcgggaggctgaggcaggagaattgcttgaactggggaggcagaggttgcagtgagacaagatcacgtcactgtactccagcctgggtgacagagtgatactccatctcaaaaaaaaaaaaaaaaaaaaaaaaaaaaaaaaaaaaaaaaacctttggtgccttttctctcttctttacctgagtaaataattggcacctgccttctttctccttttatgttatcataagtggcatgtatcaaaccaaacaggctaggggagaataggtctaattgtgacagacttaaaaacaacacattatttggaaagacaagccatgggaaagaaatatggcgtttctatttttttaagataatttagtatgtacaaaagtatccaaatttaaatatagttttcaatggctgatagttttgttttctcacccttcaatatttctagaaaacatccttgcatacaaagcaggatagctaagaaagggctgtaacaaacaaaacttcaagtgtctagcacatactacatctaagaggctaaactctgataggaaaagcactttaaacataattaaaagcttaatgtaaattagtagttgaaattctaggccggtgcggtggctcatgcctgtaatcccagcactgtaggcggccgaggtgggtgaatcacatgaggtcaggagttcaagaccagcctgaccaacatggtgaaaccccatttctactaaaaaaaaaaaaaaaa

SEQ ID NO: 147781 - DNA, 2221 bp, Homo sapiens
  Payload ID: 9236
  Gene Symbol: LMOD3
  Gene Name: leiomodin 3 (fetal)
  Uniprot ID: Q0VAK6
  ENST ID: ENST00000489031
  CDS Start-End: 116-1798
aatatagatccggcaagagcttagctgtgatcactcctagctgctcagcaaaccactgaggttcctgggaaaaaaaaaaaaatatctcaaggtaaaataatatttagaaaaaataatgtcagagcacagcagaaattcagatcaagaagaacttctcgatgaggagattaatgaagatgaaatcttggccaacttgtctgctgaagaactgaaagaactgcagtcggaaatggaagtcatggcccctgaccccagccttcccgtgggaatgattcagaaagatcaaactgacaagccaccgacaggaaacttcaatcataaatctcttgttgattatatgtattgggaaaaggcatccaggcgcatgctggaagaggaacgagttcctgtcacctttgtgaaatccgaggaaaagactcaagaagagcatgaagaaatagaaaaacgtaataaaaatatggcccagtatttaaaagaaaagctcaataatgaaatagttgcaaataaaagagaatcaaagggcagcagcaatatccaagaaacagatgaagaagatgaagaagaagaagatgatgatgatgacgacgaaggagaagatgatggtgaagagagtgaagaaacgaacagagaagaggaaggcaaagcaaaggaacaaattagaaattgtgagaacaactgccagcaggtaactgacaaagcattcaaagaacagagagacagaccagaggcccaagaacaaagtgagaaaaaaatatcgaaattagatcctaagaagttagctctagacaccagctttttgaaggtaagtacaaggccttcaggaaaccagacagacctggatgggagcttgaggagagttaggaaaaatgatcctgacatgaaggaactcaacctgaacaacattgaaaacatccccaaagaaatgttactggactttgtcaatgcaatgaagaaaaacaagcacatcaaaacattcagtttagccaatgtgggtgcagatgagaatgtagcatttgccttggctaacatgttgcgtgaaaatagaagcatcaccactctcaacatcgagtccaatttcatcacaggtaaagggattgtggccatcatgaggtgtctccagtttaatgagacgctaactgagcttcggtttcacaatcagaggcacatgttgggtcaccatgctgaaatggaaatagccaggcttttgaaggcaaacaacactctcctgaagatgggctaccattttgagcttccgggtcccagaatggtggtcactaatctgctcaccaggaatcaggataaacaaaggcagaaacgacaggaagagcaaaaacagcagcaactcaaggaacagaagaagctgatagccatgttagagaatgggttggggctgccccctgggatgtgggagctgttgggaggacccaagccagattccagaatgcaggaattcttccagccaccgccacctcggcctcccaacccccaaaatgtcccctttagtcaacgcagtgaaatgatgaaaaagccatcgcaggccccgaagtacaggacagaccctgactccttccgggtggtgaagctgaagagaatccagcgcaaatctcggatgccggaagccagagaaccacccgagaaaaccaacctcaaagatgtcatcaaaacgctcaagccagtgccgagaaacaggccacccccattggtggaaatcactcccagagatcagctgctaaacgacattcgtcacagcagtgtcgcctatcttaaacctgtgcaactgccaaaagaactggcgtaagaggcaacagagccatctagaagaacaagaaatggaaatagtgactcttggattacagcatggagactatgtcagcagcaatactttaggatccacgtggcagaactggaaacaatgctaccatctgataagggtatttgtaaaaggcagaatgtttgggccatgaagaagtaggggctgaagaggaaggtggaaggagataaaatataatatttagaggcaatattttctacttgcaatcaatttgagtgactcaggtgaaatttagagtcatatttcccgaagcagaagttaaagaaaattttttaaacatttgctttattattgttttcttctggtaaataataaatataacagaagtgttaactattgtattcccatttttttctccttccatctcttctgcggtaattcatcacatag

SEQ ID NO: 147782 - DNA, 2238 bp, Homo sapiens
  Payload ID: 9236
  Gene Symbol: LMOD3
  Gene Name: leiomodin 3 (fetal)
  Uniprot ID: Q0VAK6
  ENST ID: ENST00000475434
  CDS Start-End: 185-1867
gacatagcaagacctctgttccactgtgcaccactttatttgcttccacactcaccttgtagggaagaggcagaccctaagagcttgatttctaccttcaagtgaattctttacttcagaaacaactcaggttgctggttggatttcccttctgaaatatttaaaataatatttagaaaaaataatgtcagagcacagcagaaattcagatcaagaagaacttctcgatgaggagattaatgaagatgaaatcttggccaacttgtctgctgaagaactgaaagaactgcagtcggaaatggaagtcatggcccctgaccccagccttcccgtgggaatgattcagaaagatcaaactgacaagccaccgacaggaaacttcaatcataaatctcttgttgattatatgtattgggaaaaggcatccaggcgcatgctggaagaggaacgagttcctgtcacctttgtgaaatccgaggaaaagactcaagaagagcatgaagaaatagaaaaacgtaataaaaatatggcccagtatttaaaagaaaagctcaataatgaaatagttgcaaataaaagagaatcaaagggcagcagcaatatccaagaaacagatgaagaagatgaagaagaagaagatgatgatgatgacgacgaaggagaagatgatggtgaagagagtgaagaaacgaacagagaagaggaaggcaaagcaaaggaacaaattagaaattgtgagaacaactgccagcaggtaactgacaaagcattcaaagaacagagagacagaccagaggcccaagaacaaagtgagaaaaaaatatcgaaattagatcctaagaagttagctctagacaccagctttttgaaggtaagtacaaggccttcaggaaaccagacagacctggatgggagcttgaggagagttaggaaaaatgatcctgacatgaaggaactcaacctgaacaacattgaaaacatccccaaagaaatgttactggactttgtcaatgcaatgaagaaaaacaagcacatcaaaacattcagtttagccaatgtgggtgcagatgagaatgtagcatttgccttggctaacatgttgcgtgaaaatagaagcatcaccactctcaacatcgagtccaatttcatcacaggtaaagggattgtggccatcatgaggtgtctccagtttaatgagacgctaactgagcttcggtttcacaatcagaggcacatgttgggtcaccatgctgaaatggaaatagccaggcttttgaaggcaaacaacactctcctgaagatgggctaccattttgagcttccgggtcccagaatggtggtcactaatctgctcaccaggaatcaggataaacaaaggcagaaacgacaggaagagcaaaaacagcagcaactcaaggaacagaagaagctgatagccatgttagagaatgggttggggctgccccctgggatgtgggagctgttgggaggacccaagccagattccagaatgcaggaattcttccagccaccgccacctcggcctcccaacccccaaaatgtcccctttagtcaacgcagtgaaatgatgaaaaagccatcgcaggccccgaagtacaggacagaccctgactccttccgggtggtgaagctgaagagaatccagcgcaaatctcggatgccggaagccagagaaccacccgagaaaaccaacctcaaagatgtcatcaaaacgctcaagccagtgccgagaaacaggccacccccattggtggaaatcactcccagagatcagctgctaaacgacattcgtcacagcagtgtcgcctatcttaaacctgtgcaactgccaaaagaactggcgtaagaggcaacagagccatctagaagaacaagaaatggaaatagtgactcttggattacagcatggagactatgtcagcagcaatactttaggatccacgtggcagaactggaaacaatgctaccatctgataagggtatttgtaaaaggcagaatgtttgggccatgaagaagtaggggctgaagaggaaggtggaaggagataaaatataatatttagaggcaatattttctacttgcaatcaatttgagtgactcaggtgaaatttagagtcatatttcccgaagcagaagttaaagaaaattttttaaacatttgctttattattgttttcttctggtaaataataaatataacagaagtgttaactatt

SEQ ID NO: 147783 - DNA, 1812 bp, Homo sapiens
  Payload ID: 9237
  Gene Symbol: LMLN
  Gene Name: leishmanolysin-like (metallopeptidase M8 family)
  ENST ID: ENST00000332636
  CDS Start-End: 1-1812
atggggcggaggagtgggttactcgggctcaggcccgggccggagccggtggcgctggagcgggtcataaataaagttcatcttaaggcaaatcatgtggtcaagagagatgttgatgagcatttaagaatcaagactgtctatgataaaagtgttgaagagttgctccctgagaaaaagaatcttgtaaagaacaagcttttcccacaagcgatttcttatttagagaagacttttcaggtccgtcgacctgcgggcactatcttacttagcagacaatgtgcaacaaaccaatacctccggaaggaaaacgatcctcacaggtactgcaccggggagtgtgccgcacacacaaagtgcggccccgttattgttcctgaggaacatctccagcaatgccgggtctaccgtgggggtaagtggcctcatggagcagtgggtgtgccagaccaagaaggcatctcagatgcagactttgttctttacgttggtgctctggccaccgagagatgcagccatgaaaacatcatctcttatgcagcctattgtcagcaggaagcaaacatggacaggccaatagcaggatatgctaacctgtgtccaaatatgatctctacccagcctcaggagtttgttgggatgctgtccacagtgaaacatgaggttattcatgccctgggtttctctgctgggctgtttgcattctaccatgataaagatggaaatcctctcacttcaagatttgcagatggcctcccaccttttaattatagtctgggattatatcaatggagtgataaagtagttcgaaaagtggagagattatgggatgttcgagataataagatagttcgtcacactgtgtatctcctggtaacgcctcgtgttgttgaggaagcacgaaaacattttgattgtccagttctagagggaatggaacttgaaaatcaaggtggtgtgggcactgagctcaaccattgggaaaaaaggttattagagaatgaagcgatgactggttctcacactcagaatcgagtactctctcgaatcactctggcattaatggaggacactgggagacagatgctgagcccttactgtgacacgctcagaagtaacccactgcagctaacttgcagacaggaccagagagcagttgccgtgtgtaatttgcagaagttccctaagcctttaccacaggaataccagtactttgatgaactcagtggaatacctgcagaagatttgccttattatggtggctccgtggaaattgctgactactgccctttcagtcaggaattcagttggcatttaagtggtgaatatcagcgcagctcagattgtagaatattggaaaatcaaccagaaatttttaagaactatggcgctgaaaagtatggacctcattccgtttgtctaattcagaaatcagcattcgttatggagaagtgtgagaggaagctgagttacccagactggggaagcggatgctatcaggtttcttgttctcctcaaggtctgaaagtttgggtccaagatacttcatatttgtgtagtcgggctgggcaggtcctccctgtcagtatccagatgaatggctggattcacgatggaaacctgctctgcccatcatgttgggacttctgtgagctctgtcctccagaaacagatcctccagccactaacctgacccgagctctgccacttgatctttgttcctgttcctcgagcctggtggtcaccctctggcttctgctaggcaatctgtttcctctgctggctggatttcttctgtgtatatggcactag

SEQ ID NO: 147784 - DNA, 7043 bp, Homo sapiens
  Payload ID: 9237
  Gene Symbol: LMLN
  Gene Name: leishmanolysin-like (metallopeptidase M8 family)
  Uniprot ID: Q96KR4
  ENST ID: ENST00000330198
  CDS Start-End: 23-1990
gcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtcataaataaagttcatcttaaggcaaatcatgtggtcaagagagatgttgatgagcatttaagaatcaagactgtctatgataaaagtgttgaagagttgctccctgagaaaaagaatcttgtaaagaacaagcttttcccacaagcgatttcttatttagagaagacttttcaggtccgtcgacctgcgggcactatcttacttagcagacaatgtgcaacaaaccaatacctccggaaggaaaacgatcctcacaggtactgcaccggggagtgtgccgcacacacaaagtgcggccccgttattgttcctgaggaacatctccagcaatgccgggtctaccgtgggggtaagtggcctcatggagcagtgggtgtgccagaccaagaaggcatctcagatgcagactttgttctttacgttggtgctctggccaccgagagatgcagccatgaaaacatcatctcttatgcagcctattgtcagcaggaagcaaacatggacaggccaatagcaggatatgctaacctgtgtccaaatatgatctctacccagcctcaggagtttgttgggatgctgtccacagtgaaacatgaggttattcatgccctgggtttctctgctgggctgtttgcattctaccatgataaagatggaaatcctctcacttcaagatttgcagatggcctcccaccttttaattatagtctgggattatatcaatggagtgataaagtagttcgaaaagtggagagattatgggatgttcgagataataagatagttcgtcacactgtgtatctcctggtaacgcctcgtgttgttgaggaagcacgaaaacattttgattgtccagttctagagggaatggaacttgaaaatcaaggtggtgtgggcactgagctcaaccattgggaaaaaaggttattagagaatgaagcgatgactggttctcacactcagaatcgagtactctctcgaatcactctggcattaatggaggacactgggagacagatgctgagcccttactgtgacacgctcagaagtaacccactgcagctaacttgcagacaggaccagagagcagttgccgtgtgtaatttgcagaagttccctaagcctttaccacaggaataccagtactttgatgaactcagtggaatacctgcagaagatttgccttattatggtggctccgtggaaattgctgactactgccctttcagtcaggaattcagttggcatttaagtggtgaatatcagcgcagctcagattgtagaatattggaaaatcaaccagaaatttttaagaactatggcgctgaaaagtatggacctcattccgtttgtctaattcagaaatcagcattcgttatggagaagtgtgagaggaagctgagttacccagactggggaagcggatgctatcaggtttcttgttctcctcaaggtctgaaagtttgggtccaagatacttcatatttgtgtagtcgggctgggcaggtcctccctgtcagtatccagatgaatggctggattcacgatggaaacctgctctgcccatcatgttgggacttctgtgagctctgtcctccagaaacagatcctccagccactaacctgacccgagctctgccacttgatctttgttcctgttcctcgagcctggtggtcaccctctggcttctgctaggcaatctgtttcctctgctggctggatttcttctgtgtatatggcactaggaatggaaaagtggatcttcaagatattcttttatgttatgttcttgtgaacaaagcacaaagtttgagtgagtgccaacctatgcagatggtagaagtggcattcctggctttggcttggaagaattgacgaccatcagaccttgaagcagaacttcacagcagcctgtcctcatcagcaacccaaccaccttcatcagcaacccaaccaccttcatcagcaacccaaccacctcgtcagcaacccaaccacctcgtcagcaacccaaccacctcgtcagcaacccagccaccttcatcagcaacccaaccacctcatcagcaacccagccaccttcatcagcaacccaaccacctcatcagcaaaccaaccactttcatctgcaacccaaccactttcatcagcaactcaacaccttcatctgcaacccaaccaccttcatcagcaaaccaaccaccttcttcagcaacccaaccacctcatcttggagaaggagaaggaactgcaagccaccaagtcttcatttttcagggtttgtaatcttcccaaagttttcctttgaaaataggataatgggtggaattttcagagtgattacatacctcaacatttttattaacatacaacaatgggaaagttcatcatccatatactgcagtcacttaaacaacagccaattattgcaagattagaattggagatcttgtcctcaaaagtataaattgtcctttgagttatagaaaataatggaattgggatttctacatatcattattatacctattttaaatttaatggcagccaggcatggttccagctacttgggaggctgaggcaggaggatcgcttgagcccaggagttcaaggctgcagtgagctatgattgcaccactgtattccagcctgcacgatagagttagaccctgtatcttaaaaaaaaaaaaattaatggctggtatatagtaaacttaattcactgttcccattgttctaaagaatttttttaaataatgtttcattaaatcttatgatttaaccgtgcttgccctttttgccagctatgtggcagtttacggcagaactgctgtcagtgtgctggtagccctctattcatccctcctcagagcccagcttccagaactgctatcactgtgctggtagccctctgtattcatccctcttcagagctcagcttctggttgtattctccatgagtttaataatgacatgaaaaaatgtggaagccgagagagtaaaatactctgccctgtaaaaacatggaagacatgcaaacagaaaaaaaataattgtattgttttagataatacttaagacaactgtgaaacaacaaaaacacaactattcctttgtgaccgatgaagataaaaagaaattctggtaaagacgggtatgcagttttttaaaatgggttaagaaattgttgcagaagaatttctaacatctgaaaatggttttatgtttaagaaggatggtctgaattgtgtactaatagcaaggtataagtttggtgtagagcctatccagtagcgtccactgtaccacttttaagtaagactcagtccacagaagctggaagattgccttcgctttaaatatcctttaccttctgcatttgacactcctcctgttactacatagattccggtccccagaagcaattttacactggtactagagcttaccagccccatttagtaatttttaatggctagatgaggtttaacaagaatatgaaaagaaaaaagaaaaaatatattcatgaatgataggcgatgcccattctttctctcaagctaatgaagtcctatggcattctaaccacaaccctcggacagactcctcctattcctccatggcattgtaaccacaaccctcggacagactcctcctattcctccatggcattgtaaccacaaccctcggacagactcctcctactcctccatggcattgtaaccacaaccctcggacagactcctcctactcctccatggcattgtaaccacaaccctcggacagactcctcctactcctccatggcattgtaaccacaaccctcggacagactcctcctattcctccatggcattgtaaccacaaccctcggacagactcctcctattcctccatggcattgtaaccacaaccctcggacagactcctcctattcctccatggcattgtaaccacaaccctcggacagactcctattcctccatggcattgtaaccacaaccctcggacagactcctcctattcctccatggcattgtaaccacaaccctcggacagactccttctgttcctcctttcctcgtccttccctgcttttcgtccattcagcatatagctattcagtactccattgaagaaattatgctaagtgagcaaagcaacataattactaagaattaattctgattatttggcactagagccaacagcaaccccagcacagaggaaagtcgcttttttttcaaatgcataaatttaaagtatgtatttgcatgcagttttaaatgggaggtatttgtcattgtgaaaagctgggaatctcaaacatagtcaacttaactaaaaagaagctaatacaggttgagcattcctaatccaaaaatccagaatccaaattgctccaaaatctgaaactttctgaatgctgacctgatactacaagtagaaaattccacatacaagtacttaacacaaactttgtttcatgcacaaactactaaaaatattgtataaaattaccttcaggcagtgtgtgtagttatatatgaaacatgaatttcatgtttagacttgggtccatgcccaagatacctcattaggtatctgtaaatatccgaaatccaaaaaaaagtctgaaatctgaaacacttctggtcccaagcatttcagtaagtgatgctcaacctgcgtaatggtctgcgggccagtgctcattttctgcctatgttgtacatactttaaattgtgtaaattaaaagtcaaagcaaagagtctatttttaaagaaacttacaataatctaaacatatacttcttatgattatgaatcatcctgcaaagctgaatgaagaattttaccaaaaatacaatgaattaatcatatatttgagagtcacagtgataggttcgactatattttgactgttgtgtagtggcaccgtttaggtagtattgtttctgagcatggtgctttttatacttgaaatatatttttgctttattttttattgatataattatatttgcactaatggctttctgaagaaaatattatagatgacattttttgtatatatatttattaagcttgggaacctggtcgcccagtgttttctctggacaaatgtgaaactggataaagtatggataaagtcttgagttcctcagggtaactgtgttgatgtctcccgtcctcttcagtaaggcttgaatatgattttactcatcattgattctgcatagtgtacccagcaagacttagaaggacactgaacctgtcagagattttaagaggcacattttagtcactttgaatatggtagtggtgggcgcggtgactgaagcctgtaatctcagcacttcgggaggccaaggcaagcagatcacgagatcaggagtttgaggttacagtgagctgatcgcaccactgcactgcagcctggatgacagagtgagactttcttgggaaaaaaaaaaatgacagtgaagcagacttttagaatccgagatgtcattgcagaattattggtataaaattcagctgcaaagtgaagaaattgaaatggcccacacgttgatatcctgtggcaggttatacccttcatgttagcaaagacgaagccacgtcgctgtgttaagagggacaggctgggccggctgcagctgtagtggaagtgagggacacagggaaggaatggggagcagcaatttggggacagtagactggagtcactttctgactcaaaaagggtcaagtacttattaaaaactatcttggttttctgttcagacttaggctcattttgatcattttaaggtcccagttgtcaaaaatatcaagtgaatttgtctcaggttttcagaaacaaaatttacaggaaggaagcaaaagccatgtcagtagccttgagctgacagctttaaagaaactggcaaacaggtaggttgtcctcatatagatccttccagtattctgaaaaacatccttttatttcttaaaaccagtaacccttacatttttcctataggatagttatttttgttgagatcaaatagacattctataaatgttataaattatgcttgcagttactcagcctatctaggcttaaggtttatcaatatttgaagttgaaacatcatcttatgaggtttagttttaggaagataaataaatatatcaaagtatttcataaagttgtatcaatgttccttctaacattagaagacttactgactgaggccatctgtgaacgactaggtgatctcagaatccttccagctctaataccctctgactaacactcacccagaattgctgtctgtgctggctgtgatctgcctccaggagcatacgccatcctgcgtgctgtgtccatcacagtgtctgtgctcggtgccttaccactgtccgtgtccttggacgctgactggacagagaggagcctgtctctcagggcacatgagtcgtcgtggcaggaggagacgggcctcagtcacagtgtcacagacccttgtcacagtggacactagtcattcctgccatgtccttgcagcccaggaggactaaaaagattttaatgaagtctgtgttactcattctgaagaaaagaacttacctgagaggagtaatatttttttaatatatattgggtcagggacagggatggagtggttgttttatgtttacatttttaataagtaaaatagaagatttaagaactaatatttatggtattgaactttaagtgtgatatattccttagaaaaacacaactttaataaaaatggaaactaa

SEQ ID NO: 147785 - DNA, 474 bp, Homo sapiens
  Payload ID: 9237
  Gene Symbol: LMLN
  Gene Name: leishmanolysin-like (metallopeptidase M8 family)
  ENST ID: ENST00000419117
  CDS Start-End: 21-474
gcagaggcgtcacgcactccatggtcataaataaagttcatcttaaggcaaatcatgtggtcaagagagatgttgatgagcatttaagaatcaagactgtctatgataaaagtgttgaagagttgctccctgagaaaaagaatcttgtaaagaacaagcttttcccacaagcgatttcttatttagagaagacttttcaggtccgtcgacctgcgggcactatcttacttagcagacaatgtgcaacaaaccaatacctccggaaggaaaacgatcctcacaggtactgcaccggggagtgtgccgcacacacaaagtgcggccccgttattgttcctgaggaacatctccagcaatgccgggtctaccgtgggggtaagtggcctcatggagcagtgggtgtgccagaccaagaaggcatctcagatgcagactttgttctttacgttggtgctctggccaccgagagatgca

SEQ ID NO: 147786 - DNA, 2423 bp, Homo sapiens
  Payload ID: 9237
  Gene Symbol: LMLN
  Gene Name: leishmanolysin-like (metallopeptidase M8 family)
  Uniprot ID: Q96KR4
  ENST ID: ENST00000420910
  CDS Start-End: 1-2079
atggtaacgacgctcggcccgaagatggcggccgaatggggcggaggagtgggttactcgggctcaggcccgggccggagccggtggcgctggagcgggtctgtgtgggtccgaagcgttttactcctgttgggcgggctccgggccagcgccacatctactcccgtctccttgggcagttcccctccctgccggcaccacgtcccctctgacactgaggtcataaataaagttcatcttaaggcaaatcatgtggtcaagagagatgttgatgagcatttaagaatcaagactgtctatgataaaagtgttgaagagttgctccctgagaaaaagaatcttgtaaagaacaagcttttcccacaagcgatttcttatttagagaagacttttcaggtccgtcgacctgcgggcactatcttacttagcagacaatgtgcaacaaaccaatacctccggaaggaaaacgatcctcacaggtactgcaccggggagtgtgccgcacacacaaagtgcggccccgttattgttcctgaggaacatctccagcaatgccgggtctaccgtgggggtaagtggcctcatggagcagtgggtgtgccagaccaagaaggcatctcagatgcagactttgttctttacgttggtgctctggccaccgagagatgcagccatgaaaacatcatctcttatgcagcctattgtcagcaggaagcaaacatggacaggccaatagcaggatatgctaacctgtgtccaaatatgatctctacccagcctcaggagtttgttgggatgctgtccacagtgaaacatgaggttattcatgccctgggtttctctgctgggctgtttgcattctaccatgataaagatggaaatcctctcacttcaagatttgcagatggcctcccaccttttaattatagtctgggattatatcaatggagtgataaagtagttcgaaaagtggagagattatgggatgttcgagataataagatagttcgtcacactgtgtatctcctggtaacgcctcgtgttgttgaggaagcacgaaaacattttgattgtccagttctagagggaatggaacttgaaaatcaaggtggtgtgggcactgagctcaaccattgggaaaaaaggttattagagaatgaagcgatgactggttctcacactcagaatcgagtactctctcgaatcactctggcattaatggaggacactggctggtataaagcaaattacagcatggctgagaagttagactggggccgaggaatgggctgtgactttgtcaggaagagctgtaaattctggattgatcagcagagacaaaagagacagatgctgagcccttactgtgacacgctcagaagtaacccactgcagctaacttgcagacaggaccagagagcagttgccgtgtgtaatttgcagaagttccctaagcctttaccacaggaataccagtactttgatgaactcagtggaatacctgcagaagatttgccttattatggtggctccgtggaaattgctgactactgccctttcagtcaggaattcagttggcatttaagtggtgaatatcagcgcagctcagattgtagaatattggaaaatcaaccagaaatttttaagaactatggcgctgaaaagtatggacctcattccgtttgtctaattcagaaatcagcattcgttatggagaagtgtgagaggaagctgagttacccagactggggaagcggatgctatcaggtttcttgttctcctcaaggtctgaaagtttgggtccaagatacttcatatttgtgtagtcgggctgggcaggtcctccctgtcagtatccagatgaatggctggattcacgatggaaacctgctctgcccatcatgttgggacttctgtgagctctgtcctccagaaacagatcctccagccactaacctgacccgagctctgccacttgatctttgttcctgttcctcgagcctggtggtcaccctctggcttctgctaggcaatctgtttcctctgctggctggatttcttctgtgtatatggcactaggaatggaaaagtggatcttcaagatattcttttatgttatgttcttgtgaacaaagcacaaagtttgagtgagtgccaacctatgcagatggtagaagtggcattcctggctttggcttggaagaattgacgaccatcagaccttgaagcagaacttcacagcagcctgtcctcatcagcaacccaaccaccttcatcagcaacccaaccaccttcatcagcaacccaaccacctcgtcagcaacccaaccacctcgtcagcaacccaaccacctcgtcagcaacccagccaccttcatcagcaacccaaccacctcatcagcaacccagccaccttcatcagc

SEQ ID NO: 147787 - DNA, 2010 bp, Homo sapiens
  Payload ID: 9237
  Gene Symbol: LMLN
  Gene Name: leishmanolysin-like (metallopeptidase M8 family)
  Uniprot ID: Q96KR4
  ENST ID: ENST00000482695
  CDS Start-End: 58-1980
gcgcagaggcgtcacgcactccatggtaacgacgctcggcccgaagatggcggccgaatggggcggaggagtgggttactcgggctcaggcccgggccggagccggtggcgctggagcgggtcataaataaagttcatcttaaggcaaatcatgtggtcaagagagatgttgatgagcatttaagaatcaagactgtctatgataaaagtgttgaagagttgctccctgagaaaaagaatcttgtaaagaacaagcttttcccacaagcgatttcttatttagagaagacttttcaggtccgtcgacctgcgggcactatcttacttagcagacaatgtgcaacaaaccaatacctccggaaggaaaacgatcctcacaggtactgcaccggggagtgtgccgcacacacaaagtgcggccccgttattgttcctgaggaacatctccagcaatgccgggtctaccgtgggggtaagtggcctcatggagcagtgggtgtgccagaccaagaaggcatctcagatgcagactttgttctttacgttggtgctctggccaccgagagatgcagccatgaaaacatcatctcttatgcagcctattgtcagcaggaagcaaacatggacaggccaatagcaggatatgctaacctgtgtccaaatatgatctctacccagcctcaggagtttgttgggatgctgtccacagtgaaacatgaggttattcatgccctgggtttctctgctgggctgtttgcattctaccatgataaagatggaaatcctctcacttcaagatttgcagatggcctcccaccttttaattatagtctgggattatatcaatggagtgataaagtagttcgaaaagtggagagattatgggatgttcgagataataagatagttcgtcacactgtgtatctcctggtaacgcctcgtgttgttgaggaagcacgaaaacattttgattgtccagttctagagggaatggaacttgaaaatcaaggtggtgtgggcactgagctcaaccattgggaaaaaaggttattagagaatgaagcgatgactggttctcacactcagaatcgagtactctctcgaatcactctggcattaatggaggacactggctggtataaagcaaattacagcatggctgagaagttagactggggccgaggaatgggctgtgactttgtcaggaagagctgtaaattctggattgatcagcagagacaaaagagacagatgctgagcccttactgtgacacgctcagaagtaacccactgcagctaacttgcagacaggaccagagagcagttgccgtgtgtaatttgcagaagttccctaagcctttaccacaggaataccagtactttgatgaactcagtggaatacctgcagaagatttgccttattatggtggctccgtggaaattgctgactactgccctttcagtcaggaattcagttggcatttaagtggtgaatatcagcgcagctcagattgtagaatattggaaaatcaaccagaaatttttaagaactatggcgctgaaaagtatggacctcattccgtttgtctaattcagaaatcagcattcgttatggagaagtgtgagaggaagctgagttacccagactggggaagcggatgctatcaggtttcttgttctcctcaaggtctgaaagtttgggtccaagatacttcatatttgtgtagtcgggctgggcaggtcctccctgtcagtatccagatgaatggctggattcacgatggaaacctgctctgcccatcatgttgggacttctgtgagctctgtcctccagaaacagatcctccagccactaacctgacccgagctctgccacttgatctttgttcctgttcctcgagcctggtggtcaccctctggcttctgctaggcaatctgtttcctctgctggctggatttcttctgtgtatatggcactaggaatggaaaagtggatcttcaagatattct

SEQ ID NO: 147788 - DNA, 604 bp, Homo sapiens
  Payload ID: 9238
  Gene Symbol: LEMD1
  Gene Name: LEM domain containing 1
  Uniprot ID: Q68G75
  ENST ID: ENST00000367149
  CDS Start-End: 47-250
atttcaaggattctaccatcagaaaagaggccaaacttctatcatcatggtggatgtgaagtgtctgagtgactgtaaattgcagaaccaacttgagaagcttggattttcacctggcccaatactacgtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaacaagg

SEQ ID NO: 147789 - DNA, 869 bp, Homo sapiens
  Payload ID: 9238
  Gene Symbol: LEMD1
  Gene Name: LEM domain containing 1
  Uniprot ID: Q68G75
  ENST ID: ENST00000367151
  CDS Start-End: 47-592
atttcaaggattctaccatcagaaaagaggccaaacttctatcatcatggtggatgtgaagtgtctgagtgactgtaaattgcagaaccaacttgagaagcttggattttcacctggcccaatactaccttccaccagaaagttgtatgaaaaaaagttagtacagttgttggtctcacctccctgtgcaccacctgtgatgaatggacccagagagctggatggagcgcaggacagtgatgacagcgaagagcttaatatcattttgcaaggaaatatcatactctcaacagaaaaaagcaagaaactcaaaaaatggcctgaggcttccaccactaaacgcaaagctgtagatacctattgcttggattataagccttccaagggaagaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaacaagg

SEQ ID NO: 147790 - DNA, 741 bp, Homo sapiens
  Payload ID: 9238
  Gene Symbol: LEMD1
  Gene Name: LEM domain containing 1
  Uniprot ID: Q68G75
  ENST ID: ENST00000367152
  CDS Start-End: 39-461
gattctaccatcagaaaagaggccaaacttctatcatcatggtggatgtgaagtgtctgagtgactgtaaattgcagaaccaacttgagaagcttggattttcacctggcccaatactacagcttaatatcattttgcaaggaaatatcatactctcaacagaaaaaagcaagaaactcaaaaaatggcctgaggcttccaccactaaacgcaaagctgtagatacctattgcttggattataagccttccaagggaagaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaacaaggaaa

SEQ ID NO: 147791 - DNA, 929 bp, Homo sapiens
  Payload ID: 9238
  Gene Symbol: LEMD1
  Gene Name: LEM domain containing 1
  Uniprot ID: Q68G75
  ENST ID: ENST00000367153
  CDS Start-End: 104-649
agtgaaactcacccagctttagtaaccaactcgattgcatagactttagataaccatgtgaaggggattctaccatcagaaaagaggccaaacttctatcatcatggtggatgtgaagtgtctgagtgactgtaaattgcagaaccaacttgagaagcttggattttcacctggcccaatactaccttccaccagaaagttgtatgaaaaaaagttagtacagttgttggtctcacctccctgtgcaccacctgtgatgaatggacccagagagctggatggagcgcaggacagtgatgacagcgaagagcttaatatcattttgcaaggaaatatcatactctcaacagaaaaaagcaagaaactcaaaaaatggcctgaggcttccaccactaaacgcaaagctgtagatacctattgcttggattataagccttccaagggaagaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaacaaggaaa

SEQ ID NO: 147792 - DNA, 786 bp, Homo sapiens
  Payload ID: 9238
  Gene Symbol: LEMD1
  Gene Name: LEM domain containing 1
  Uniprot ID: Q68G75
  ENST ID: ENST00000367154
  CDS Start-End: 103-429
agtggctctgcggggaattgtgaggcggactgcgagggaaagggggccttgttgagtccgccaggattctaccatcagaaaagaggccaaacttctatcatcatggtggatgtgaagtgtctgagtgactgtaaattgcagaaccaacttgagaagcttggattttcacctggcccaatactaccttccaccagaaagttgtatgaaaaaaagttagtacagttgttggtctcacctccctgtgcaccacctgtgatgaatggacccagagagctggatggagcgcaggacagtgatgacagcgaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaacaaggaaa

SEQ ID NO: 147793 - DNA, 727 bp, Homo sapiens
  Payload ID: 9238
  Gene Symbol: LEMD1
  Gene Name: LEM domain containing 1
  Uniprot ID: Q68G75
  ENST ID: ENST00000391936
  CDS Start-End: 47-373
atttcaaggattctaccatcagaaaagaggccaaacttctatcatcatggtggatgtgaagtgtctgagtgactgtaaattgcagaaccaacttgagaagcttggattttcacctggcccaatactaccttccaccagaaagttgtatgaaaaaaagttagtacagttgttggtctcacctccctgtgcaccacctgtgatgaatggacccagagagctggatggagcgcaggacagtgatgacagcgaaggtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaacaagg

SEQ ID NO: 147794 - DNA, 637 bp, Homo sapiens
  Payload ID: 9238
  Gene Symbol: LEMD1
  Gene Name: LEM domain containing 1
  Uniprot ID: Q68G75
  ENST ID: ENST00000495594
  CDS Start-End: 77-280
gaagtgagtgcaagaggagccggcttagcatctaaactgattctaccatcagaaaagaggccaaacttctatcatcatggtggatgtgaagtgtctgagtgactgtaaattgcagaaccaacttgagaagcttggattttcacctggcccaatactacgtgggctgcaagagcaccaagcaccagaatcacatatgggactatcaccaaagagagagactactgcgcggaagaccagactatcgagagctggagagaagaaggtttcccagtgggcttgaagcttgctgtgcttggtattttcatcattgtggtgtttgtctacctgactgtggaaaataagtcgctgtttggttaagtaatttaggagcaaagcaatgctccaagcgaggcctcctgcttcaggaaagaaccaaaacactaccctgaagggccagcctagcctgcagccctcccttgcagggagccttcccttgcactgtgctgctctcacagatcggtgtctgggctcagccaggtggaaggaacctgcctaaccaggcacctgtgttaagagcatgatggttaggaaatcccccaagtcatgtcaactctcattaaaggtgcttccatatttgagcaggcgtcaaacaaggaaa

SEQ ID NO: 147795 - DNA, 2958 bp, Homo sapiens
  Payload ID: 9239
  Gene Symbol: LEMD2
  Gene Name: LEM domain containing 2
  Uniprot ID: Q8NC56
  ENST ID: ENST00000293760
  CDS Start-End: 21-1532
cggggggcggcgtcctggccatggccggcctgtcggacctggaactgcggcgggagctgcaggccctgggcttccagccaggacccatcaccgacaccacccgggatgtctaccgcaacaagctgcgccgcctgcggggcgaggcccggctgcgcgacgaggagcggctgcgggaggaggcccggccgcggggcgaggagcggttacgggaagaggcccggttacgcgaggatgcgccgctgcgcgcccggcccgccgcggcctctccgcgggcggagccctggctctcccagccggcctcgggctcggcctacgcgacccctggggcctacggtgatatccggccctccgcggcttcctgggtagggagccgcggcctcgcctatcctgcccgcccggcgcaactcaggcgccgcgcctcggtccggggcagctccgaggaggacgaggacgcccggacgcccgacagggccacgcagggcccgggtctcgcggcccgccgctggtgggcagcgtctcccgccccggcgcggctgccttcctccctcctcggtcccgacccgcgcccgggcctgcgggcgactcgagcgggccctgctggcgcggcgagggcccggcctgaggtggggcgccggctggagcgctggctctctcggcttctgctctgggccagcctagggctactgctcgtcttcctgggcatcctttgggtgaagatgggcaagccctcagcgccgcaggaggcggaggacaacatgaagttattgccagtggactgtgagagaaaaacagatgagttctgtcaggccaagcagaaggcagccttgctggagctgctgcatgaactctacaatttcctggccatccaagctggtaattttgagtgtggaaatccagagaatctaaaaagcaaatgcattcctgttatggaagcccaagaatatatagccaatgtgaccagcagctcctccgccaagtttgaagccgcactgacctggatactgagcagtaacaaggacgtgggcatctggttgaaaggagaagaccagtctgaattggtgacgactgtggacaaggtggtctgcctggaatctgcccacccccgcatgggtgttggctgccgcctgagccgggccttgctcactgctgtcaccaacgtgctcatcttcttctggtgcttggcttttttgtgggggctcctaattctcctaaaatatcggtggcgaaagttagaagaggaggaacaagccatgtatgagatggtgaagaagattatagacgtggtccaggaccattacgtggactgggagcaggacatggagcgctatccatatgtaggcatcctgcacgtgcgcgacagcttgatccctccacagagccggaggcgcatgaagcgtgtctgggaccgagctgtggagttcctggcctccaacgaatcccggatccagacggagtcccaccgcgttgcaggagaggacatgctggtgtggagatggactaagccctcttccttctctgactcagagcgataagccccgggcggggacttgttcccggtcagcctgtcccaggacagcccactccagaggcacaggagggtcaccaggcctgcggtgctgaattcacacttgccttgactttcagtctcgtcctgacacgattccaaaggtctgccatactcttcagaggagttcggctcgcaggaaaatgtgggcttcctttaaagggagggggagaagccagggtgatagcccagactctgccctgttgtgctggcagaaacggggagaagggttgagttttcatgaatagaaaacaagagcagcagctgtcaggcccagctgacaagcgtggggctggtgggctggggcatggccacgccagggagtctgtcacctgggaggtggggcagggatggtgtttcgggtggcgggatggggagcagcttggtccatgtgccttcagggggttgttacttgagagctccagggtgaagggagaaagcctgtgctctggctggctgggcctctatcctgaagagggaaggtgctagaaattagaacaagtgactgtaggggggaccgtctagaaacaccaggcccagacacacggtccctcaggtcaggaggagtgagcagccggcacagcctcctgggaggatcccgaagtagggactggggctgagagcagagaggagggtcgggcagccccagggcgggcgggcccgcctcagtgttgcttctcacagaagctgcgactctagaccaggcctgcagccagaacgccgattccgggagcttgggagccctgcgtcagggcccagagcctcgcacttgctgtgtgcgaagatcgccttgctttactgtgaccacagccccgacgcggggctgtttaacaagaacttcagcgcagccggcgtttctgttaccccggccgcggctcttggcggcgggagaggcgcagtggctgcaggctgccccctgccggccacaagggagcagcgtccgcgccgccgcccaccggccctcccgccagctcctcagcctgctccctgggaggcaggctccagaagcaccccgacggggggccttattaagtgcgagaagcctctccagcgagtcttccccgtgtgtcctcatctgcggcaggcaggagagggggagcaaacaggaaattccacagctgcctccagaaacattaaccacccctctctagtcttactggtattttttgtttccttaataaagctccagtctccctcatttgagcaatactctcatttcctctgatgtctggatgatcggcagggcaggaatctgagcgctggccccgtggtgaggccatgttctcataatcaggctccagccagaaaaataagaaacaccgcaacaggcttcagtatcagggctgaaactgctggatgaataaactatttattaaaaacggatgtttcttgcc

SEQ ID NO: 147796 - DNA, 2323 bp, Homo sapiens
  Payload ID: 9239
  Gene Symbol: LEMD2
  Gene Name: LEM domain containing 2
  ENST ID: ENST00000421671
  CDS Start-End: 10-354
gtcctggccatggccggcctgtcggacctggaactgcggcgggagctgcaggccctgggcttccagccaggacccatcaccgacaccacccgggatgtctaccgcaacaagctgcgccgcctgcggggcgaggcccggctgcgcgacgaggagcggctgcgggaggaggcccggccgcggggcgaggagcggttacgggaagaggcccggttacgcgaggatgcgccgctgcgcgcccggcccgccgcggcctctccgcgggcggagccctggctctcccagccggcctcgggctcggcctacgcgacccctggggcctacggtgatatccggccctccgcggcttcctggtgaagttattgccagtggactgtgagagaaaaacagatgagttctgtcaggccaagcagaaggcagccttgctggagctgctgcatgaactctacaatttcctggccatccaagctggtaattttgagtgtggaaatccagagaatctaaaaagcaaatgcattcctgttatggaagcccaagaatatatagccaatgtgaccagcagctcctccgccaagtttgaagccgcactgacctggatactgagcagtaacaaggacgtgggcatctggttgaaaggagaagaccagtctgaattggtgacgactgtggacaaggtggtctgcctggaatctgcccacccccgcatgggtgttggctgccgcctgagccgggccttgctcactgctgtcaccaacgtgctcatcttcttctggtgcttggcttttttgtgggggctcctaattctcctaaaatatcggtggcgaaagttagaagaggaggaacaagccatgtatgagatggtgaagaagattatagacgtggtccaggaccattacgtggactgggagcaggacatggagcgctatccatatgtaggcatcctgcacgtgcgcgacagcttgatccctccacagagccggaggcgcatgaagcgtgtctgggaccgagctgtggagttcctggcctccaacgaatcccggatccagacggagtcccaccgcgttgcaggagaggacatgctggtgtggagatggactaagccctcttccttctctgactcagagcgataagccccgggcggggacttgttcccggtcagcctgtcccaggacagcccactccagaggcacaggagggtcaccaggcctgcggtgctgaattcacacttgccttgactttcagtctcgtcctgacacgattccaaaggtctgccatactcttcagaggagttcggctcgcaggaaaatgtgggcttcctttaaagggagggggagaagccagggtgatagcccagactctgccctgttgtgctggcagaaacggggagaagggttgagttttcatgaatagaaaacaagagcagcagctgtcaggcccagctgacaagcgtggggctggtgggctggggcatggccacgccagggagtctgtcacctgggaggtggggcagggatggtgtttcgggtggcgggatggggagcagcttggtccatgtgccttcagggggttgttacttgagagctccagggtgaagggagaaagcctgtgctctggctggctgggcctctatcctgaagagggaaggtgctagaaattagaacaagtgactgtaggggggaccgtctagaaacaccaggcccagacacacggtccctcaggtcaggaggagtgagcagccggcacagcctcctgggaggatcccgaagtagggactggggctgagagcagagaggagggtcgggcagccccagggcgggcgggcccgcctcagtgttgcttctcacagaagctgcgactctagaccaggcctgcagccagaacgccgattccgggagcttgggagccctgcgtcagggcccagagcctcgcacttgctgtgtgcgaagatcgccttgctttactgtgaccacagccccgacgcggggctgtttaacaagaacttcagcgcagccggcgtttctgttaccccggccgcggctcttggcggcgggagaggcgcagtggctgcaggctgccccctgccggccacaagggagcagcgtccgcgccgccgcccaccggccctcccgccagctcctcagcctgctccctgggaggcaggctccagaagcaccccgacggggggccttattaagtgcgagaagcctctccagcgagtcttccccgtgtgtcctcatctgcggcaggcaggagagggggagcaaacaggaaattccacagctgcctccagaaacattaaccacccctctctagtcttactggtatt

SEQ ID NO: 147797 - DNA, 839 bp, Homo sapiens
  Payload ID: 9239
  Gene Symbol: LEMD2
  Gene Name: LEM domain containing 2
  ENST ID: ENST00000442696
  CDS Start-End: 1-839
cggcctacgcgacccctggggcctacggtgatatccggccctccgcggcttcctgggtagggagccgcggcctcgcctatcctgcccgcccggcgcaactcaggcgccgcgcctcggtccggggcagctccgaggaggacgaggacgcccggacgcccgacagggccacgcagggcccgggtctcgcggcccgccgctggtgggcagcgtctcccgccccggcgcggctgccttcctccctcctcggtcccgacccgcgcccgggcctgcgggcgactcgagcgggccctgctggcgcggcgagggcccggcctgaggtggggcgccggctggagcgctggctctctcggcttctgctctgggccagcctagggctactgctcgtcttcctgggcatcctttgggtgaagatgggcaagccctcagcgccgcaggaggcggaggacaacagtaattttgagtgtggaaatccagagaatctaaaaagcaaatgcattcctgttatggaagcccaagaatatatagccaatgtgaccagcagctcctccgccaagtttgaagccgcactgacctggatactgagcagtaacaaggacgtgggcatctggttgaaaggagaagaccagtctgaattggtgacgactgtggacaaggtggtctgcctggaatctgcccacccccgcatgggtgttggctgccgcctgagccgggccttgctcactgctgtcaccaacgtgctcatcttcttctggtgcttggcttttttgtgggggctcctaattctcctaaaatatcggtggcgaaagttagaagaggaggaacaagccatgtatgagatg

SEQ ID NO: 147798 - DNA, 643 bp, Homo sapiens
  Payload ID: 9239
  Gene Symbol: LEMD2
  Gene Name: LEM domain containing 2
  ENST ID: ENST00000504692
  CDS Start-End: 1-307
ggtctgcctggaatctgcccacccccgcatgggtgttggctgccgcctgagccgggccttgctcactgctgtcaccaacgtgctcatcttcttctggtgcttggcttttttgtgggggctcctaattctcctaaaatatcggtggcgaaagttagaagaggaggaacaagccatgtatgagatggtgaagaagattatagacgtggtccaggaccattacgtggactgggagcaggacatggagcgctatccatatgtaggcatcctgcacgtgcgcgacagcttgatccctccacagagccggtgagtccctggctggggcgctgggtgtgaggtaagatggggtccgaccccactgagctccccagaaggaaacccagagccttgcatcagatgtcagctgagggcagtgcagaccccagggccaagagtggctctgctcccactcctgctgctccccagcatgctcggctctttatggcaggatgagctagaaaagacatatgaaagcacaatcccacacctctgtagagagaacactggcagtggtgataccagttaggaggccttgggctccaagtaatagcagctccctcccccagggcacaagtagtgaaggatctcctcagtctctgtaagtgga

SEQ ID NO: 147799 - DNA, 1306 bp, Homo sapiens
  Payload ID: 9239
  Gene Symbol: LEMD2
  Gene Name: LEM domain containing 2
  Uniprot ID: Q8NC56
  ENST ID: ENST00000508327
  CDS Start-End: 398-1003
ttcagctgggacaaggacccagctatcgtaattcctaatccaggatttggatacccttacattttgctgtctgcattttaaaagtgccttccttagatgacatctttctaatccccacccttggcttggtaatgctttactccctccaaatgttgtgagtagtctctttttgtattcctttctcaacccacacttaatttcctctgtgtttcttttcttggtctcagtgaagttattgccagtggactgtgagagaaaaacagatgagttctgtcaggccaagcagaaggcagccttgctggagctgctgcatgaactctacaatttcctggccatccaagctggtaattttgagtgtggaaatccagagaatctaaaaagcaaatgcattcctgttatggaagcccaagaatatatagccaatgtgaccagcagctcctccgccaagtttgaagccgcactgacctggatactgagcagtaacaaggacgtgggcatctggttgaaaggagaagaccagtctgaattggtgacgactgtggacaaggtggtctgcctggaatctgcccacccccgcatgggtgttggctgccgcctgagccgggccttgctcactgctgtcaccaacgtgctcatcttcttctggtgcttggcttttttgtgggggctcctaattctcctaaaatatcggtggcgaaagttagaagaggaggaacaagccatgtatgagatggtgaagaagattatagacgtggtccaggaccattacgtggactgggagcaggacatggagcgctatccatatgtaggcatcctgcacgtgcgcgacagcttgatccctccacagagccggaggcgcatgaagcgtgtctgggaccgagctgtggagttcctggcctccaacgaatcccggatccagacggagtcccaccgcgttgcaggagaggacatgctggtgtggagatggactaagccctcttccttctctgactcagagcgataagccccgggcggggacttgttcccggtcagcctgtcccaggacagcccactccagaggcacaggagggtcaccaggcctgcggtgctgaattcacacttgccttgactttcagtctcgtcctgacacgattccaaaggtctgccatactcttcagaggagttcggctcgcaggaaaatgtgggcttcctttaaagggagggggagaagccagggtgatagcccagactctgccctgttgtgctggcagaaacggggagaagggttgagttttcatgaatagaaaacaagagcagcagctgtcag

SEQ ID NO: 147800 - DNA, 555 bp, Homo sapiens
  Payload ID: 9239
  Gene Symbol: LEMD2
  Gene Name: LEM domain containing 2
  ENST ID: ENST00000513701
  CDS Start-End: 395-555
gagttaagcagggaaggcccatttgatcccgttttacagacgaggagacagaggttcagagtggttgagttgcccaagaaacttgagctaatcattttcagctgggacaaggacccagctatcgtaattcctaatccaggatttggatacccttacattttgctgtctgcattttaaaagtgccttccttagatgacatctttctaatccccacccttggcttgtgaagttattgccagtggactgtgagagaaaaacagatgagttctgtcaggccaagcagaaggcagccttgctggagctgctgcatgaactctacaatttcctggccatccaagctggtaattttgagtgtggaaatccagagaatctaaaaagcaaatgcattcctgttatggaagcccaagaatatatagccaatgtgaccagcagctcctccgccaagtttgaagccgcactgacctggatactgagcagtaacaaggacgtgggcatctggttgaaaggagaagaccagtctgaattggtgacgactgtggacaaggtggtctgcct

SEQ ID NO: 147801 - DNA, 1684 bp, Homo sapiens
  Payload ID: 9239
  Gene Symbol: LEMD2
  Gene Name: LEM domain containing 2
  ENST ID: ENST00000506578
  CDS Start-End: 1-258
attatagacgtggtccaggaccattacgtggactgggagcaggacatggagcgctatccatatgtaggcatcctgcacgtgcgcgacagcttgatccctccacagagccggcgcatgaagcgtgtctgggaccgagctgtggagttcctggcctccaacgaatcccggatccagacggagtcccaccgcgttgcaggagaggacatgctggtgtggagatggactaagccctcttccttctctgactcagagcgataagccccgggcggggacttgttcccggtcagcctgtcccaggacagcccactccagaggcacaggagggtcaccaggcctgcggtgctgaattcacacttgccttgactttcagtctcgtcctgacacgattccaaaggtctgccatactcttcagaggagttcggctcgcaggaaaatgtgggcttcctttaaagggagggggagaagccagggtgatagcccagactctgccctgttgtgctggcagaaacggggagaagggttgagttttcatgaatagaaaacaagagcagcagctgtcaggcccagctgacaagcgtggggctggtgggctggggcatggccacgccagggagtctgtcacctgggaggtggggcagggatggtgtttcgggtggcgggatggggagcagcttggtccatgtgccttcagggggttgttacttgagagctccagggtgaagggagaaagcctgtgctctggctggctgggcctctatcctgaagagggaaggtgctagaaattagaacaagtgactgtaggggggaccgtctagaaacaccaggcccagacacacggtccctcaggtcaggaggagtgagcagccggcacagcctcctgggaggatcccgaagtagggactggggctgagagcagagaggagggtcgggcagccccagggcgggcgggcccgcctcagtgttgcttctcacagaagctgcgactctagaccaggcctgcagccagaacgccgattccgggagcttgggagccctgcgtcagggcccagagcctcgcacttgctgtgtgcgaagatcgccttgctttactgtgaccacagccccgacgcggggctgtttaacaagaacttcagcgcagccggcgtttctgttaccccggccgcggctcttggcggcgggagaggcgcagtggctgcaggctgccccctgccggccacaagggagcagcgtccgcgccgccgcccaccggccctcccgccagctcctcagcctgctccctgggaggcaggctccagaagcaccccgacggggggccttattaagtgcgagaagcctctccagcgagtcttccccgtgtgtcctcatctgcggcaggcaggagagggggagcaaacaggaaattccacagctgcctccagaaacattaaccacccctctctagtcttactggtattttttgtttccttaataaagctccagtctccctcatttgagcaatactctcatttcctctgatgtctggatgatcggcagggcaggaatctgagcgctggccccgtggtgaggccatgttctcataatcaggctccagccagaaaaataagaaacaccgcaacaggcttcagtatcagggctgaaactgctggatgaataaactatttattaaaaacggatgtttcttgcc

SEQ ID NO: 147802 - DNA, 2883 bp, Homo sapiens
  Payload ID: 9239
  Gene Symbol: LEMD2
  Gene Name: LEM domain containing 2
  Uniprot ID: Q8NC56
  ENST ID: ENST00000614475
  CDS Start-End: 4-1515
gccatggccggcctgtcggacctggaactgcggcgggagctgcaggccctgggcttccagccaggacccatcaccgacaccacccgggatgtctaccgcaacaagctgcgccgcctgcggggcgaggcccggctgcgcgacgaggagcggctgcgggaggaggcccggccgcggggcgaggagcggttacgggaagaggcccggttacgcgaggatgcgccgctgcgcgcccggcccgccgcggcctctccgcgggcggagccctggctctcccagccggcctcgggctcggcctacgcgacccctggggcctacggtgatatccggccctccgcggcttcctgggtagggagccgcggcctcgcctatcctgcccgcccggcgcaactcaggcgccgcgcctcggtccggggcagctccgaggaggacgaggacgcccggacgcccgacagggccacgcagggcccgggtctcgcggcccgccgctggtgggcagcgtctcccgccccggcgcggctgccttcctccctcctcggtcccgacccgcgcccgggcctgcgggcgactcgagcgggccctgctggcgcggcgagggcccggcctgaggtggggcgccggctggagcgctggctctctcggcttctgctctgggccagcctagggctactgctcgtcttcctgggcatcctttgggtgaagatgggcaagccctcagcgccgcaggaggcggaggacaacatgaagttattgccagtggactgtgagagaaaaacagatgagttctgtcaggccaagcagaaggcagccttgctggagctgctgcatgaactctacaatttcctggccatccaagctggtaattttgagtgtggaaatccagagaatctaaaaagcaaatgcattcctgttatggaagcccaagaatatatagccaatgtgaccagcagctcctccgccaagtttgaagccgcactgacctggatactgagcagtaacaaggacgtgggcatctggttgaaaggagaagaccagtctgaattggtgacgactgtggacaaggtggtctgcctggaatctgcccacccccgcatgggtgttggctgccgcctgagccgggccttgctcactgctgtcaccaacgtgctcatcttcttctggtgcttggcttttttgtgggggctcctaattctcctaaaatatcggtggcgaaagttagaagaggaggaacaagccatgtatgagatggtgaagaagattatagacgtggtccaggaccattacgtggactgggagcaggacatggagcgctatccatatgtaggcatcctgcacgtgcgcgacagcttgatccctccacagagccggaggcgcatgaagcgtgtctgggaccgagctgtggagttcctggcctccaacgaatcccggatccagacggagtcccaccgcgttgcaggagaggacatgctggtgtggagatggactaagccctcttccttctctgactcagagcgataagccccgggcggggacttgttcccggtcagcctgtcccaggacagcccactccagaggcacaggagggtcaccaggcctgcggtgctgaattcacacttgccttgactttcagtctcgtcctgacacgattccaaaggtctgccatactcttcagaggagttcggctcgcaggaaaatgtgggcttcctttaaagggagggggagaagccagggtgatagcccagactctgccctgttgtgctggcagaaacggggagaagggttgagttttcatgaatagaaaacaagagcagcagctgtcaggcccagctgacaagcgtggggctggtgggctggggcatggccacgccagggagtctgtcacctgggaggtggggcagggatggtgtttcgggtggcgggatggggagcagcttggtccatgtgccttcagggggttgttacttgagagctccagggtgaagggagaaagcctgtgctctggctggctgggcctctatcctgaagagggaaggtgctagaaattagaacaagtgactgtaggggggaccgtctagaaacaccaggcccagacacacggtccctcaggtcaggaggagtgagcagccggcacagcctcctgggaggatcccgaagtagggactggggctgagagcagagaggagggtcgggcagccccagggcgggcgggcccgcctcagtgttgcttctcacagaagctgcgactctagaccaggcctgcagccagaacgccgattccgggagcttgggagccctgcgtcagggcccagagcctcgcacttgctgtgtgcgaagatcgccttgctttactgtgaccacagccccgacgcggggctgtttaacaagaacttcagcgcagccggcgtttctgttaccccggccgcggctcttggcggcgggagaggcgcagcgtccgcgccgccgcccaccggccctcccgccagctcctcagcctgctccctgggaggcaggctccagaagcaccccgacggggggccttattaagtgcgagaagcctctccagcgagtcttccccgtgtgtcctcatctgcggcaggcaggagagggggagcaaacaggaaattccacagctgcctccagaaacattaaccacccctctctagtcttactggtattttttgtttccttaataaagctccagtctccctcatttgagcaatactctcatttcctctgatgtctggatgatcggcagggcaggaatctgagcgctggccccgtggtgaggccatgttctcataatcaggctccagccagaaaaataagaaacaccgcaacaggcttcagtatcagggctgaaactgctggatgaataaactatttatt

SEQ ID NO: 147803 - DNA, 4764 bp, Homo sapiens
  Payload ID: 9240
  Gene Symbol: LEMD3
  Gene Name: LEM domain containing 3
  Uniprot ID: Q9Y2U8
  ENST ID: ENST00000308330
  CDS Start-End: 27-2762
agcttgtaaaacaccctggagagaaaatggcggcggcagcagcttcggcgcctcagcagctctcggatgaggagcttttctctcagctccgccgttacggcctgtctcccggaccagtgacggagagcacccgcccggtctacctcaagaagctgaagaagcttcgagaggaagagcagcaacagcaccggtcagggggccgcggcaacaagacgcggaacagtaataacaataacacggcagccgccacggtcgcagccgcgggaccagcggcggcggcggccgcggggatgggggtccggccggtctcgggcgacctctcctacttacggactcctgggggcctgtgccgaatctcggcctctggcccagagagcctcctgggagggcccgggggcgcctccgccgcccccgcggctggcagcaaagtgctgctgggcttcagctcggacgagtcggacgtggaggccagtccccgggaccaggccggcggcggcgggaggaaagaccgggcttcgctccagtaccgcgggctcaaagcgccgccggcgcccctggccgccagcgaggtgactaacagcaactctgcagagcgaaggaagccccactcgtggtggggggccaggaggccggcgggccccgagctgcagaccccgccggggaaagatggagcagtggaggacgaggaaggggagggagaggacggtgaggagagggacccggagaccgaggagccgctctgggcgagccggaccgtgaatggcagccggcttgtcccctacagctgccgggaaaactattcggactcagaggaagaggacgacgacgacgtggcctccagcagacaggtattaaaggacgactccctttcccggcatcggcccagacgaacccatagtaagcctctccccccgctgactgctaaatcggccggcggcaggctggagacttcagttcagggagggggaggactcgcgatgaatgacagggcggcggctgccgggagtctagacaggagccgaaacctcgaagaggcggcggccgcggagcagggaggagggtgtgatcaagtggactccagccccgttcctagataccgtgttaacgctaagaaactgacccctctcctgcccccgccacttactgacatggactcaaccttggattcgtcaacaggctcccttctgaaaaccaataatcatattggcggtggggccttcagtgtggactcccccaggatttattctaacagtctccctcccagtgcggcggtggccgcctctagttcactcaggatcaatcacgccaatcatacgggctccaatcatacctacctgaaaaacacatacaacaaaccgaagctttccgaacccgaagaggaacttctccagcaatttaaacgggaggaggtgtccccaacagggagtttcagtgcccactacttgtcgatgtttctcttaactgctgcctgcttatttttcctaatactgggactgacttacctaggaatgagagggacaggagtatctgaggatggagaactcagcatagaaaacccctttggtgaaacatttggaaaaatacaagaaagtgaaaaaactcttatgatgaacacattatataagcttcatgatcgattggcacagcttgcaggagatcatgaatgtggcagttctagtcaaagaacgctttctgttcaagaggcagctgcgtatttaaaagatttaggtcctgaatatgaaggtatatttaacacttcattgcagtggatcttagaaaatggaaaagatgttggaataaggtgtgttggttttggccctgaggaagaattgacaaatataactgatgtgcagtttttacagtccacaagaccactgatgtctttttggtgtcgttttcgacgtgcttttgttactgtaactcacagattattgttgttatgcttaggtgtagtgatggtttgtgtcgttctgcgttacatgaaatatcgatggacaaaagaagaggaggaaacaaggcagatgtatgatatggtggtaaagattatagatgttttacgaagtcataatgaagcctgccaggaaaacaaagatttacaaccttacatgcctattccacatgtacgcgattccttaatacagcctcatgacaggaaaaaaatgaagaaagtctgggatagagctgttgacttccttgctgctaatgagtctagagttcgcacggaaacacgaagaataggtggtgcagattttctggtttggcggtggatccagccttctgcatcctgtgacaaaatattagttataccttctaaagtatggcaaggtcaagcatttcatttagatagaagaaattcaccaccaaatagtttgacaccgtgtctaaagattcggaatatgtttgatcccgttatggaaataggggatcagtggcatttggcaattcaagaagcaattttagaaaaatgcagtgataatgatggcattgttcacattgcagtagacaaaaattcacgtgagggttgtgtatatgttaaatgtctgtctccagaatatgctggaaaggcttttaaagcattgcatggctcttggtttgatgggaaattggttacagtaaaatatttacgactagatagataccaccatcgctttccccaggctctcacttccaacactccattgaagccatcaaataaacatatgaactccatgtctcatcttcgtcttcggactggcctaaccaattctcaaggaagttcctgaaaagattttcttccatttctaagactgttatttacaataggaaaattcctgtttggctttttgtcttcctttttaaatgctttttgtatgtaatatttttattgatgaatacatctctgaacgttccagaagtcttaaggttccaaagggatttagcagtgaggcagcaatgctgagtaggtaggataattatttcattcagtttttggagctcagttaagccaatacatttaaagttttgcatgaggaacactgactttattaagcattttcagatgtggtggttgtatttttgccccaagaagtgtttggataaccacacaaaagcatgatgaaaaggcttcttgtagtcccataatttcttgtgaactaatgttgtgaatttttgtatacagtcacctgcatagttcctacaggctaatgtggtaaaactgttgatttcccaatttaaccttaggtttctgttgcttataagcgattcatttgctacggctggaatatgggaaaattaatttgggcttagtggttacaaatatgtgtaagtggatgtatatgtacttaaactggctttgtatatatgtataaatgctggtggtggtgaaagtagtcttgttttatgaggatgtctgcattaaagcagtaaaataagctttccattttattcataatctaatgtgtgtgtatatatgtatgtgtgtatgtgtgtgtatatatagatgtatatatatacacacacagagatatatacatatggctgtacttttgcatagatcaaacagccaaacacctggaagtattagatacaagtttaaaatatcttttataggttttatataaaaatgtctgagtatgattttgtgtgaaagttctgataccagttgtaatagagtcaaatttatgtgagcaataaagaagaaattggcagatattggaaaaatattttgtgaaaagctgtatttattataaatactagggccatgacatagtaccattggggttaagtcattttcccaatctatttataatttaatgatatgttagtgcctctgttatatgtcaagtttaaagcagggcacattgttgcagcaaaatgtgtatttgacaaattatacttgcaattttgggtcatgaaagtttgcaatatagtaaatgcacgattgactgttgctttgtgcctcagtatttaatttgtttcagtaaacttactttattactgtttatgatttcagataaaaatagttgctgagtaaattttacttgtaatctacaattggctttttaaaaataacctgttgatatataattgtcagtccaaatgaatatgtgaaacagctggaattgtacaaattttggttgtatttaaagctcagtttcctttttgttttattgtatgcgttgggtttgcagcatgaacttgcacagataatgcacgttttctggttaagtaaacatgatgcacactattctgtaacagaaagccctattgtgccttacctgtgtgcttttgtgggcaccttgtttatgaagaataaaaaatgatttgttatctgaagagaataaattttaaattctcagtttatgtctcagatgctaacgtgtgaaaatataaatatatataatatataaagtaaccagtcttcctgtattttatgtgcatcatagtgatttatctgagcttagtgacccccatcttgtaacctgttgcaagagtgaatgtaaaaaatagttgtggcattttaaaaggtcgcctttgatgcagatgcatctttttcttgcttctaaaacatatttcatgtaaacattgtacatttattattgtaatatatactattatgcagcttattttacctgaaactgttaagccgaccaagatccctccctgcaagacagatgggaatgtgtataataactaggtatttgagaagttctgaagtttgatgtaatctgttacttgtcctgttaaaaaaaggaaaaaattctaattaaaaatttattagttttt

SEQ ID NO: 147804 - DNA, 8946 bp, Homo sapiens
  Payload ID: 9241
  Gene Symbol: LMTK2
  Gene Name: lemur tyrosine kinase 2
  Uniprot ID: Q8IWU2
  ENST ID: ENST00000297293
  CDS Start-End: 294-4805
gcggcgggagcgcggcttcccaggcccgccgctccgcagggctgctggcgttgctgctgttgagaggcggcggcggcggcgcaggcgggcgggaaggatggtgtttctgcgactggagcggcaggtgcggaccgggagccggaccgaggtttggcagaagcaacgtgtgctcgggagcaaccggcgcgggtgccactgaggcagcggagggaggcaggatcgactgacgggcgaacggacggacggacggaaggcgactcgagggccggccccggagccgcgccgtgggcgagatgccggggccgccggcgttgcggcggaggctgctgctgctgctgctggtcctcctgatcgccggcagtgctggggccgcgccacttccgcaaacaggtgcaggggaggcgccacctgctgcagaagtttcctcatcttttgtgatcctgtgtgtgtgcagtttaataatattaatagtgttaattgcaaactgtgtatcctgctgtaaggacccagaaatagactttaaggaatttgaagataattttgatgatgagatagatttcacaccaccagcagaagacactccctctgttcagtccccagcagaggtcttcacactttcagtaccaaatatttcactcccagctccctcgcaattccagccttctgtagagggattgaagtctcaagttgcccgccacagtctaaactacatacaggaaattggaaatggctggtttggaaaggttctcttgggagagatttacacgggcactagcgtagcaagagtcatcgtgaaggagttaaaagcaagtgccaacccaaaggaacaagatacttttttgaaaaatggagaaccttactacattcttcagcatccaaatattcttcagtgtgttggacagtgcgtagaagcgattccctacctcctggtgtttgagttctgtgacttgggtgacctgaaggcgtatctgcgcagcgagcaggagcacatgcggggggactcacagaccatgctgctgcagaggatggcgtgcgaggtcgccgcggggctggccgccatgcacaagctgcacttcctgcacagtgatttagccctgcggaattgttttctcacctccgacttaaatgtgaaagtgggagattacggaataggattcagcaggtacaaggaggattatattgaaacagatgataaaaaagttttccctctgcgatggactgctccagaattagtaaccagctttcaagacagactgctaactgcagatcagactaagtatagtaatatctggtctctgggtgtgacactttgggagctttttgacaatgccgcacagccgtattcaaacctttccaacttagatgtcctcaaccaagtcattagagagagagacacaaaactcccgaagccccagctggagcagccctactctgatagatggtatgaagtcttacagttctgttggctgtcaccagaaaagagacccgcggctgaagatgtgcacaggctgctgacttacctgcggctgcagagccagcgggactcagaggtcgactttgaacagcagtggaacgctctgaagccgaacacaaacagcagagactcctccaacaatgctgcattcccaattctcgaccactttgccagggaccggctgggtcgtgaaatggaggaagtcctcaccgtgaccgaaaccagccagggcctgagcttcgagtatgtctgggaggccgctaagcacgaccactttgacgagcgcagccggggccacctggacgaaggcttgtcctacacgagcatcttctatccggttgaagtttttgagagttcgctttcagatcctgggcccggaaagcaagatgacagcggccaggatgtccccctgagggtccctggagtggttcctgtttttgatgcccacaacctttctgttggaagcgactattatatccagttagaagaaaaaagtggtagtaacttggagcttgattacccaccagcgctgctcacaaccgacatggataatccagaaaggactggccctgaactgtcccagctcacggcgctcaggagcgttgaacttgaggagtccagtacagatgaggacttcttccaaagcagtacagaccccaaagactctagcttaccaggggacttacacgtgaccagtggccccgagagccctttcaacaatatatttaatgatgtggacaaatcggaagatttgcccagtcaccaaaaaatattcgacttaatggaattaaacggagttcaagccgactttaaacctgccactttaagttccagtttggataaccccaaagagtcagtcataacaggccactttgagaaagaaaagccccgtaagatttttgacagtgagcctctctgcctatcagataatcttatgcaccaagataattttgatccattgaatgttcaagaattgtcagaaaactttttatttcttcaagagaaaaacttactaaaaggctcattgtccagcaaagaacacataaatgatcttcagacagaacttaagaatgctggttttactgaagctatgttagaaacgtcatgtagaaactctttagatactgagcttcagtttgctgaaaataagccaggcttgtctttgttgcaggaaaacgtaagcacaaagggtgacgatacagatgtcatgctcacaggtgacactttgagcacctcattgcagtcttccccggaagtgcaggtacctcctacctccttcgaaacagaagaaacgccccgtcgggtacccccagactcactcccaacacagggagaaacccagcccacgtgtttagatgttattgtcccggaggactgtctccaccaggacatcagtccagacgctgtgactgtcccggttgaaattctctcaactgatgccagaacccacagcctggataacaggtcccaggactctcctggcgagagtgaggagaccctgcgactcaccgaaagtgactctgttcttgctgatgacatccttgccagcagggtgagtgtagggagtagtctcccggaactgggacaggaattgcacaataaaccattttcggaagaccatcacagtcatcgccggctagagaaaaacttagaggctgtggagactttaaatcagctcaattctaaagacgcagcaaaagaagcaggcttggtgtctgccctctcctcggactcaaccagtcaggacagcctcctggaggacagcttgtcagcacccttcccagcctctgagccgtccctggaaaccccggactctctggagtcagtggatgtccacgaagcgctactggactctttaggatctcacactccccagaaactagtgccccccgataagccggcagacagtggctacgaaacagagaacttggagtctcccgagtggaccttgcatcccgctcccgagggcaccgcagactcagaaccagccaccacgggcgatggcggccacagcggtctgcctcccaacccggtcattgtcatctcagatgccggcgatggtcacagaggcacagaagtgacccctgagacgttcacagctggctcccagggttcataccgagactctgcgtacttctcagacaatgactctgagcccgagaaaaggtctgaggaggtcccgggaacctccccatccgccttggtgttggtacaggagcagcccctacccgagccagtcctccccgagcaaagtcctgctgcccaggatagctgcctggaagccagaaagagccagccagatgaaagttgtctgtctgctttgcacaactccagtgacctggaattaagagccacgccggagccagcacagactggtgttccccagcaggtgcatcccacggaagacgaggccagcagtccctggagtgtgctgaatgcagaacttagcagcggcgatgacttcgagacacaggacgatcgcccctgcaccctcgcttccacggggaccaacacgaacgaactccttgcctacaccaattctgcgctggacaagtccctgtccagccactccgagggcccgaagttgaaggagccggacatcgaagggaagtacctggggaaactcggggtgtcagggatgctcgacctctcagaggacgggatggatgcagacgaggaggacgaaaacagcgacgactcggacgaggacctgcgggccttcaacctgcatagcctcagctccgagtcggaggacgagaccgagcaccccgtgcccatcatcctcagcaacgaggacggaaggcacctgcggagtctgttgaagcccacagcggccaatgcccccgacccactgcccgaggactggaagaaggaaaagaaggcagtcacgtttttcgatgatgtcacagtctacctgtttgaccaggagaccccaaccaaagagctggggccctgtggaggagaggcgtgcggcccggacctgagcggcccagccccagcctcaggctctccctacctgagcaggtgcatcaactccgaaagctccaccgacgaagaaggtggtggctttgagtgggatgatgacttctccccagatccttttatgtcaaagacaacaagtaacctgctcagctccaagccttctctccaaacatccaagtacttttctccgccgccaccggcccggagcacggagcagagctggccgcactcggcgccttactcccggttctccatctctcccgccaacattgccagcttttccctcacacacctgaccgactcggacatcgagcagggcggaagcagcgaagacggagaaaaggactaggtggctgccaacgcgcacgctcgggtccgaggctgctcccctggagcggcgcccctgcgccctcagcccgagcagcgacatccactcgccatttgctgacatgagattgggaggaagaatccagaggtgaagagggagacggctcttagctgcgttcaaggcggggccctcgggagcccaggtgcagagcgaggccgtgtccaggagccggcgtccctcagtgccccgtgcacccgcggccgcggcctcccaggcagtgctcatgcgctggccgtcgggggaggcaggggcacagcctccatgtgcgcgcgcgtgtggagctgtgtgcaccgcatgtgtgctttccacaggggcgtctctgcgtccacgcctgcacatcccggcgcacgtgtgggcaccacagaggacacgtgaggggaatggtcaccagtgagccatatttattatttctagagaaatcacgaactgctttctgtaattgcactgtggataaatgttccgagagtctccattgttgtacaggatcttcagttattcgaggggaatgaggcaggtcaagccgatgctagccactagtttgattttttttctgttttatagtttgcgctgcatggtacttgtgaagcttaaatattttgagtgttctactgtgtctaggattgttgggattgtacatatggtactctttcataaatgataaatgattctgaatgttagtgttttatgttcatataggaaatattttcattgagtccaaaataccactgttttgttgatggacttgaatgcatttttgtctcttcttgatgaagcggctttgccgcagcaaatgaggcttctctctgaggagctgagaggtcttgcagcctctccttgtcattctcccaccccacatcccattttttaaagcccttttggtaaaaaccaacaggttgtggccgcagacctcagatggacccggcccatccctggggacgtgctggcgtggcaggtccagagagctgcaccctgcacggggcaccgcaccgcttccctccgcgcagctcttctgcctggttttcggaggccaggctgctgggaagcttccgtgttcctgtcagtccttccttcaagaagccggggaactcaggcagactcatctccgcagagcataccagccgtgggggaccgttcgacttgatgatgtgtgcacacttcaggtggtggggacttgagctttaaaaaaacctccacagccgaatcttctcctccgagccactccacgtcacgtccagctgggcctggccagtctgtggttatccatgtgggatgagataacaccacatcctgcagctgtgaagggggatggacaagggacgacggccgacggcagagcatcagcagccgacacatagttcgggtcggggccttgggtggtcctgcatggcccgggactcatctcacggaccctccgttctgcattaagccccaggttctcttctggctttgaaagggcccgagtgctcccagtgtagcttcgtcacatcgtcacgagcccctgtggtcatgggcgacctcacacctccctccctgagttctgctctgacataaggaagtcctcggtggctggtgcagcgcggctgtgctgtgctggggaggcagccgttccttcgggggtccttgggcctgcagtcccctcatactcacccttcacccaacatattttccggtgctgatatgtttccagactccagcgcaacctggggtgctctccagacccgtgcaggggccgcctggggtacacggaaggaagttgagtcctagtgcaaaatgcaggcggacgttgccagagagtgcgcagcaaatgaccttcattgccagttccaccctactcctctcattttttatactaagcaataactttccaaagcaagaagttcaggatggagagagtcccctcctgtgtaggcatggggtggatgcggtgcccacctgggctatgtggggagcaccactgtctcgggatgcgcgaattttttttttttttttaattaacagggcattagaagatgattttgccaaaattgtcatgactctgaattcttgctgtggggacttcctgagttttctcagtttttacatctaagattagtcttggctgaagagaaatgagacgtgattatactactttttcaattgcaggtttaaggagttcagatttaatgaccaaagtcatacagatcatggaatctgtcgtcgtcttatacagtgtcagcctcgagtacatttattaaccttttggggctgtcagttttccactaggattaagattttggccgggcgcggtggctcacgcctgcaatcccaacacattggggggtcgaggcggacggatcactttgagcccaggagttcaagaccagcctgggcaacatggcgaaacctcgtctctactaaaaatacaaaatatatatatatatatatatactagctggggcacatagtggtgtgcacctgtagtcccagctgcttgggaggctgaggtgggaggatggctagagcccaggagatgggtgttgcagtgagctgagaccatgccactgtactctagcctgggtaacagccagaccctgtctcaaaaaaaaaaacaatttttttcataacataattcccatttttatttattttgagtcactcataattaattgccaaaaaagcattttatacattgagttggggggtagtggatcttagtgtggtgttgcatggaggggcgagattttatatttataatcaacacgtgggttaacatgtttttttgaaatccaagcaatacacaggaaatttaagtagaataaaaattgcagcccatttttgaaatgtcagcatgtgctgtgttcagttcaggtttttgttgtttgttttgttattttttaactaataagttggttatcagtggtgggttttcaaaatgtacttgttctaataagttgtacaatgaactaaatcagtggcattctctagataatgtgggggaaggttagaatattttctggccttctatggggtagcaacccagaatcaatctgaattagtcctgttttggtggagtttgtacattttaaatcctataacaaaaataatctagttttcatttccttactagctagatgcgaatttgtctttttgaatgaccctgtcaataagccagaaagggcaacccagaaaaagtgctccccacatccttctgagacttggcctgtgtgtgtggacgagaagccattcaccgtaagggtgcagaaagctcgaccaagccgaattgcaaacaacgttcgttctatttttaaatgtacaggttcgatcgtttctatagaaatgggtttatctaagaaaagtcttggtttgtcttgctgctgtaaaaggcctttccaaacccctccttttattcctgtttcccgaaataaggtatttgtagagttaaggacctactgcatgcctgtccccagggccccggtggaaggaaggcagcgcctgctcttccttaactcagcccatcatctgaaaattcagaagtgaaccaagggttagacgccagaggttgggcttctgttagagtggcttcaaaacatgagccttatgggaagtagccttaaaaaaagaatgggtatacgcagtgacttccgatggaaatctccaaaacaatattcctaagtagcaatggggttggctcaagtctttattaacaaagaacattctctttcatctataaagaaattcttaaagatgcattgacagtgttgaattaccaacagcctgtgaagatcagtttgaccggtgtggacacgtgctggttaagcactcaggcctacgtgggccgagcgggatcttgatcatggggctggtgtatggatccaccgtcggattccgtctgcagaggaggacgtagggggccgtcacacccaccaggcctccctgctgtgctttaacacaggcagaagaggttcatggcaatataatagtcaatgaactttcagtttaaattgtgtacatttttaaattgtaagatttttactgtatattgatgcatagtgtgattcaataaattgcttgtaatttaaaaactatttaatattcaaaataaatatagttatatatttataaa

SEQ ID NO: 147805 - DNA, 4972 bp, Homo sapiens
  Payload ID: 9242
  Gene Symbol: LMTK3
  Gene Name: lemur tyrosine kinase 3
  ENST ID: ENST00000270238
  CDS Start-End: 1-4470
atgaggcaagtgctgtggttgtgtaatgtctgcgtaaccgcacgggaaacccgccaccacctccacctccctgccatcctcgacaagatgcctgcccccggcgccctcatcctccttgcggccgtctccgcctccggctgcctggcgtccccggcccaccccgatggattcgccctgggccgggctcctctggctcctccctacgctgtggtcctcatttcctgctccggcctgctggccttcatcttcctcctcctcacctgtctgtgctgcaaacggggcgatgtcggcttcaaggaatttgagaaccctgaaggggaggactgctccggggagtacactccccctgcggaggagacctcctcctcacagtcgctgcctgatgtctacattctcccgctggctgaggtctccctgccaatgcctgccccgcagccttcacactcagacatgaccacccccctgggccttagccggcagcacctgagctacctgcaggagattgggagtggctggtttgggaaggtgatcctgggagagattttctccgactacacccccgcccaggtggtggtgaaggagctccgagccagcgcggggcccctggagcaacgcaagttcatctcggaagcacagccgtacaggagcctgcagcaccccaatgtcctccagtgcctgggtctgtgcgtggagacgctgccgtttctgctgattatggagttctgtcaactgggggacctgaagcgttacctccgagcccagcggccccccgagggcctgtcccctgagctaccccctcgagacctgcggacgctgcagaggatgggcctggagatcgcccgcgggctggcgcacctgcattcccacaactacgtgcacagcgacctggccctgcgcaactgcctgctgacctctgacctgaccgtgcgcatcggagactacgggctggcccacagcaactacaaggaggactactacctgaccccagagcgcctgtggatcccactgcgctgggcggcgcccgagctcctcggggagctccacgggaccttcatggtggtggaccagagccgcgagagcaacatctggtccctgggggtgaccctgtgggagctgtttgagtttggggcccagccctaccgccacctgtcagacgaggaggtcctcgccttcgtggtccgccagcagcatgtgaagctggcccggccgaggctcaagctgccttacgcggactactggtatgacattcttcagtcctgctggcggccacctgcccagcgcccttcagcctctgatctccaattgcagctcacctacttgctctccgagcggcctccccggcccccaccgccgccacccccaccccgagacggtcccttcccctggccctggccccctgcacacagtgcgccccgcccggggaccctctcctcaccgttccccctactggatggcttccctggagccgaccccgacgatgtgctcacggtcaccgagagtagccgcggcctcaacctcgagtgcctgtgggagaaggcccggcgtggggccggccggggtgggggggcacctgcctggcagccggcgtcggcccccccggccccccacgccaacccctccaaccctttctacgaggcgctgtccacgcccagcgtgctgcctgtcatcagcgcccgcagcccctccgtgagcagcgagtactacatccgcttggaggagcacggctcccctcctgagcccctcttccccaacgactgggaccccctggacccaggagtgcccgcccctcaggccccccaggccccctccgaggtcccccagctggtgtccgagacctgggcctcccccctcttccctgcgccccggcccttcccagcccagtcctcagcgtcaggcagcttcctgctgagcggctgggaccccgagggccggggcgccggggagaccctggcgggagaccctgccgaggtcttgggggagcgggggaccgccccgtgggtggaagaagaagaggaggaggaggagggcagctccccaggggaagacagcagcagccttggaggtggcccaagccgccggggtcccctaccctgtcccctgtgcagccgcgagggggcctgctcctgcctgccactggagcggggggacgccgtagcaggctggggaggccaccctgctcttggctgcccccacccccccgaggacgactcctcgctgcgggcagagcggggctccctggccgacttgcccatggccccccccgcctcggccccccccgagtttctggaccccctcatgggggcggcggcgccccagtaccccgggcgggggccacctcccgctcccccccccccgccgccacctcctcgggcccccgcggacccggccgcgtcccccgaccccccttcggccgtggccagtcccggttcaggcctctcgtcgccgggccccaagccgggggacagcggctacgagaccgagacccctttttccccagagggagccttcccaggtgggggggcggccgaggaggaaggggtccctcggccgcgggctccccccgagccacccgacccaggagcgccccggccacctccagacccgggtccgctcccactcccggggccccgggagaagccgaccttcgtggttcaagtgagcacggaacagctgctgatgtccctgcgggaggatgtgacaaggaacctcctgggggagaagggggcgacagcccgggagacaggacccaggaaggcggggagaggccccgggaacagagagaaagtcccgggcctgaacagggacccgacagtcctgggcaacgggaaacaagccccaagcctgagcctcccagtgaacggggtgacagtgctggagaacggggaccagagagccccaggcatcgaggagaaggcggcggagaatggggccctggggtcccccgagagagaagagaaagtgctggagaatggggagctgacacccccaaggagggaggagaaagcgctggagaatggggagctgaggtccccagaggccggggagaaggtgctggtgaatgggggcctgacacccccaaagagcgaggacaaggtgtcagagaatgggggcctgagattccccaggaacacggagaggccaccagagactgggccttggagagccccagggccctgggagaagacgcccgagagttggggtccagcccccacgatcggggagccagccccagagacctctctggagagagcccctgcacccagcgcagtggtctcctcccggaacggcggggagacagcccctggcccccttggcccagcccccaagaacgggacgctggaacccgggaccgagaggagagcccccgagactgggggggcgccgagagccccaggggctgggaggctggacctcgggagtgggggccgagccccagtgggcacggggacggcccccggcggcggccccggaagcggcgtggacgcaaaggccggatgggtagacaacacgaggccgcagccaccgccgccaccgctgccaccgccaccggaggcacagccgaggaggctggagccagcgcccccgagagccaggccggaggtggcccccgagggagagcccggggccccagacagcagggccggcggagacacggcactcagcggagacggggacccccccaagcccgagaggaagggccccgagatgccacgactattcttggacttgggaccccctcaggggaacagcgagcagatcaaagccaggctctcccggctctcgctggcgctgccgccgctcacgctcacgccattcccggggccgggcccgcggcggcccccgtgggagggcgcggacgccggggcggctggcggggaggccggcggggcgggagcgccggggccggcggaggaggacggggaggacgaggacgaggacgaggaggaggacgaggaggcggcggcgccgggcgcggcggcggggccgcggggccccgggagggcgcgagcagccccggtgcccgtcgtggtgagcagcgccgacgcggacgcggcccgcccgctgcgggggctgctcaagtctccgcgcggggccgacgagccagaggacagcgagctggagaggaagcgcaagatggtctccttccacggggacgtgaccgtctacctcttcgaccaggagacgccaaccaacgagctgagcgtccaggccccccccgagggggacacggacccgtcaacgcctccagcgcccccgacacctccccaccccgccacccccggagatgggtttcccagcaacgacagcggctttggaggcagtttcgagtgggcggaggatttccccctcctcccccctccaggccccccgctgtgcttctcccgcttctccgtctcgcctgcgctggagaccccggggccacccgcccgggcccccgacgcccggcccgcaggccccgtggagaattgattccccgaagacccgaccccgctgcaccctcagaagaggggttgagaatggaatcctctgtggatgacggcgccactgccaccaccgcagacgccgcctctggggaggcccccgaggctgggccctccccctcccactcccctaccatgtgccaaacgggaggccccgggcccccgccccccagccccccagatggctcccctgacccccctgaccccctcggagccaaatgaggcaggaatccccccgcccctccatagagagccgcctttctcggaactgaactgaactcttttgggcctggagcccctcgacacagcggaggtccctcctcacccactcctggcccaagacaggggccgcaggcttcggggacccggaccccccatttcgcgtctcccctttccctccccagcccggcccctggaggggcctctggttcaaaccttcgcgtggcattttcacattatttaaaaaagacaaaaacaactttttggaggaa

SEQ ID NO: 147806 - DNA, 5113 bp, Homo sapiens
  Payload ID: 9242
  Gene Symbol: LMTK3
  Gene Name: lemur tyrosine kinase 3
  Uniprot ID: Q96Q04
  ENST ID: ENST00000600059
  CDS Start-End: 229-4611
cctctgtccgcctctccatcccttcatccgtctgtcccttcaaagagggggaggggggtacctgagccagcaagcagcccctccctccccctgtcctgcgtctcctgcccctctcctgggccgggaggaggccagggtcgcgcgggtccccatggctgggggctgagggcccgcccccccctcctccccagccgccaccacctccacctccctgccatcctcgacaagatgcctgcccccggcgccctcatcctccttgcggccgtctccgcctccggctgcctggcgtccccggcccaccccgatggattcgccctgggccgggctcctctggctcctccctacgctgtggtcctcatttcctgctccggcctgctggccttcatcttcctcctcctcacctgtctgtgctgcaaacggggcgatgtcggcttcaaggaatttgagaaccctgaaggggaggactgctccggggagtacactccccctgcggaggagacctcctcctcacagtcgctgcctgatgtctacattctcccgctggctgaggtctccctgccaatgcctgccccgcagccttcacactcagacatgaccacccccctgggccttagccggcagcacctgagctacctgcaggagattgggagtggctggtttgggaaggtgatcctgggagagattttctccgactacacccccgcccaggtggtggtgaaggagctccgagccagcgcggggcccctggagcaacgcaagttcatctcggaagcacagccgtacaggagcctgcagcaccccaatgtcctccagtgcctgggtctgtgcgtggagacgctgccgtttctgctgattatggagttctgtcaactgggggacctgaagcgttacctccgagcccagcggccccccgagggcctgtcccctgagctaccccctcgagacctgcggacgctgcagaggatgggcctggagatcgcccgcgggctggcgcacctgcattcccacaactacgtgcacagcgacctggccctgcgcaactgcctgctgacctctgacctgaccgtgcgcatcggagactacgggctggcccacagcaactacaaggaggactactacctgaccccagagcgcctgtggatcccactgcgctgggcggcgcccgagctcctcggggagctccacgggaccttcatggtggtggaccagagccgcgagagcaacatctggtccctgggggtgaccctgtgggagctgtttgagtttggggcccagccctaccgccacctgtcagacgaggaggtcctcgccttcgtggtccgccagcagcatgtgaagctggcccggccgaggctcaagctgccttacgcggactactggtatgacattcttcagtcctgctggcggccacctgcccagcgcccttcagcctctgatctccaattgcagctcacctacttgctctccgagcggcctccccggcccccaccgccgccacccccaccccgagacggtcccttcccctggccctggccccctgcacacagtgcgccccgcccggggaccctctcctcaccgttccccctactggatggcttccctggagccgaccccgacgatgtgctcacggtcaccgagagtagccgcggcctcaacctcgagtgcctgtgggagaaggcccggcgtggggccggccggggtgggggggcacctgcctggcagccggcgtcggcccccccggccccccacgccaacccctccaaccctttctacgaggcgctgtccacgcccagcgtgctgcctgtcatcagcgcccgcagcccctccgtgagcagcgagtactacatccgcttggaggagcacggctcccctcctgagcccctcttccccaacgactgggaccccctggacccaggagtgcccgcccctcaggccccccaggccccctccgaggtcccccagctggtgtccgagacctgggcctcccccctcttccctgcgccccggcccttcccagcccagtcctcagcgtcaggcagcttcctgctgagcggctgggaccccgagggccggggcgccggggagaccctggcgggagaccctgccgaggtcttgggggagcgggggaccgccccgtgggtggaagaagaagaggaggaggaggagggcagctccccaggggaagacagcagcagccttggaggtggcccaagccgccggggtcccctaccctgtcccctgtgcagccgcgagggggcctgctcctgcctgccactggagcggggggacgccgtagcaggctggggaggccaccctgctcttggctgcccccacccccccgaggacgactcctcgctgcgggcagagcggggctccctggccgacttgcccatggccccccccgcctcggccccccccgagtttctggaccccctcatgggggcggcggcgccccagtaccccgggcgggggccacctcccgctcccccccccccgccgccacctcctcgggcccccgcggacccggccgcgtcccccgaccccccttcggccgtggccagtcccggttcaggcctctcgtcgccgggccccaagccgggggacagcggctacgagaccgagacccctttttccccagagggagccttcccaggtgggggggcggccgaggaggaaggggtccctcggccgcgggctccccccgagccacccgacccaggagcgccccggccacctccagacccgggtccgctcccactcccggggccccgggagaagccgaccttcgtggttcaagtgagcacggaacagctgctgatgtccctgcgggaggatgtgacaaggaacctcctgggggagaagggggcgacagcccgggagacaggacccaggaaggcggggagaggccccgggaacagagagaaagtcccgggcctgaacagggacccgacagtcctgggcaacgggaaacaagccccaagcctgagcctcccagtgaacggggtgacagtgctggagaacggggaccagagagccccaggcatcgaggagaaggcggcggagaatggggccctggggtcccccgagagagaagagaaagtgctggagaatggggagctgacacccccaaggagggaggagaaagcgctggagaatggggagctgaggtccccagaggccggggagaaggtgctggtgaatgggggcctgacacccccaaagagcgaggacaaggtgtcagagaatgggggcctgagattccccaggaacacggagaggccaccagagactgggccttggagagccccagggccctgggagaagacgcccgagagttggggtccagcccccacgatcggggagccagccccagagacctctctggagagagcccctgcacccagcgcagtggtctcctcccggaacggcggggagacagcccctggcccccttggcccagcccccaagaacgggacgctggaacccgggaccgagaggagagcccccgagactgggggggcgccgagagccccaggggctgggaggctggacctcgggagtgggggccgagccccagtgggcacggggacggcccccggcggcggccccggaagcggcgtggacgcaaaggccggatgggtagacaacacgaggccgcagccaccgccgccaccgctgccaccgccaccggaggcacagccgaggaggctggagccagcgcccccgagagccaggccggaggtggcccccgagggagagcccggggccccagacagcagggccggcggagacacggcactcagcggagacggggacccccccaagcccgagaggaagggccccgagatgccacgactattcttggacttgggaccccctcaggggaacagcgagcagatcaaagccaggctctcccggctctcgctggcgctgccgccgctcacgctcacgccattcccggggccgggcccgcggcggcccccgtgggagggcgcggacgccggggcggctggcggggaggccggcggggcgggagcgccggggccggcggaggaggacggggaggacgaggacgaggacgaggaggaggacgaggaggcggcggcgccgggcgcggcggcggggccgcggggccccgggagggcgcgagcagccccggtgcccgtcgtggtgagcagcgccgacgcggacgcggcccgcccgctgcgggggctgctcaagtctccgcgcggggccgacgagccagaggacagcgagctggagaggaagcgcaagatggtctccttccacggggacgtgaccgtctacctcttcgaccaggagacgccaaccaacgagctgagcgtccaggccccccccgagggggacacggacccgtcaacgcctccagcgcccccgacacctccccaccccgccacccccggagatgggtttcccagcaacgacagcggctttggaggcagtttcgagtgggcggaggatttccccctcctcccccctccaggccccccgctgtgcttctcccgcttctccgtctcgcctgcgctggagaccccggggccacccgcccgggcccccgacgcccggcccgcaggccccgtggagaattgattccccgaagacccgaccccgctgcaccctcagaagaggggttgagaatggaatcctctgtggatgacggcgccactgccaccaccgcagacgccgcctctggggaggcccccgaggctgggccctccccctcccactcccctaccatgtgccaaacgggaggccccgggcccccgccccccagccccccagatggctcccctgacccccctgaccccctcggagccaaatgaggcaggaatccccccgcccctccatagagagccgcctttctcggaactgaactgaactcttttgggcctggagcccctcgacacagcggaggtccctcctcacccactcctggcccaagacaggggccgcaggcttcggggacccggaccccccatttcgcgtctcccctttccctccccagcccggcccctggaggggcctctggttcaaaccttcgcgtggcattttcacattatttaaaaaagacaaaaacaactttttggaggaa

SEQ ID NO: 147807 - DNA, 1949 bp, Homo sapiens
  Payload ID: 9243
  Gene Symbol: LGSN
  Gene Name: lengsin, lens protein with glutamine synthetase domain
  Uniprot ID: Q5TDP6
  ENST ID: ENST00000370657
  CDS Start-End: 35-1564
gtggtttctaacgctgaacttaaaaagtgttgagatgaataatgaagaggaccttctgcaggaggactcaacaagagatgaaggcaatgagactgaagccaacagcatgaacacattaagaaggacaaggaagaaagtcactaaaccatatgtttgttcaactgaagtgggagaaacggatatgtccaattcaaatgattgcatgagggacagcagtcaaattttgaccccacctcaactctcttctagaatgaaacacattagacaagccatggccaaaaatcgcctccagtttgtacgatttgaagcaacagacctccacggcgtgtccaggtctaagactatccctgcacacttttttcaagagaaagtgagccatggtgtttgcatgccccgaggttatcttgaagtgataccaaatccaaaggacaatgaaatgaataacataagagccacatgttttaatagcgacatagtcctaatgccagagttatcaacctttagagttttgccatgggctgacagaactgcaagagtgatatgtgataccttcactgtgactggtgagcctcttttgacttccccaaggtacattgcaaagaggcagctgagccatctgcaggcctctggcttttccctgctttctgctttcatctatgatttttgcatttttggtgtgcccgaaattttaaattcaaagattatatcttttcctgctttaacatttttaaataaccatgatcagcccttcatgcaggaacttgttgatggcttgtatcacactggagccaatgtcgagagtttttcctcctctaccaggcctggtcagatggaaatctctttcctgcctgaatttggcattagctcagctgataatgcatttaccctcagaacaggtgtcaaagaagtggcaaggaaatataattacattgccagcttcttcattgagactggattttgtgattcagggattttgtctcatagtctctgggatgtcgataggaagaaaaacatgttctgcagcacttctggaactgagcagctcacgatcactgggaaaaaatggttggcaggactcttgaagcactctgctgcgctcagctgcctgatggcgccttctgttagctgccgaaagcgttattccaaggacaggaaagacctgaagaagagtgtgcctacaacatggggatacaatgacaacagctgtatatttaatatcaaatgtcatggagagaaaggcacccggatagaaaataaactaggctcagcaacagcaaacccttacttggtgctggctgcaactgttgctgccggcttagatggacttcatagcagtaatgaggtcttggctggtccagatgagagcacagacttttaccaagtggaaccttctgagatccctttaaaactagaagatgcccttgtggcactggaagaagatcaatgcctgagacaggctctaggagaaacctttattcgatattttgttgccatgaagaaatatgagttggagaatgaagaaatagctgcagagagaaataaattcttagagtattttatttagaatagagctcacaactactcctttagacatgtaattgttacttaaagctaatctaccaaaacaaaaagactgaacttttgtaattaacaacagcaacaataacaagattacgaatgcttttgacttttttttttgtccatggaatatttgacagatgaagtaggactgctgagaagattctgataacagaaacaaacaacaaagttgtggtgaagctataatatgcaaacttaccagatcttgtcagtcatttcctatgtgtatgttgacctggataagaatatccaattttgggtggcaataaatatattcgcacattaagaaaaaaaagacttaagcattagaaagcaaaatttaaatgactaaaaaagaaaaaaaagaaaag

SEQ ID NO: 147808 - DNA, 5213 bp, Homo sapiens
  Payload ID: 9243
  Gene Symbol: LGSN
  Gene Name: lengsin, lens protein with glutamine synthetase domain
  Uniprot ID: Q5TDP6
  ENST ID: ENST00000370658
  CDS Start-End: 35-661
gtggtttctaacgctgaacttaaaaagtgttgagatgaataatgaagaggaccttctgcaggaggactcaacaagagatgaaggcaatgagactgaagccaacagcatgaacacattaagaaggacaaggaagaaagtcactaaaccatatgtttgttcaactgaagtgggagaaacggatatgtccaattcaaatgattgcatgagggacagcagtcaaattttgaccccacctcaactctcttctagaatgaaacacattagacaagccatggccaaaaatcgcctccagtttgtacgatttgaagcaacagacctccacggcgtgtccaggtctaagactatccctgcacacttttttcaagagaaagtgagccatggtgtttgcatgccccgaggttatcttgaagtgataccaaatccaaaggacaatgaaatgaataacataagagccacatgttttaatagcgacatagtcctaatgccagagttatcaacctttagagttttgccatgggctgacagaactgcaagagtgatatgtgataccttcactgtgactgtctctgggatgtcgataggaagaaaaacatgttctgcagcacttctggaactgagcagctcacgatcactgggaaaaaatggttggcaggactcttgaagcactctgctgcgctcagctgcctgatggcgccttctgttagctgccgaaagcgttattccaaggacaggaaagacctgaagaagagtgtgcctacaacatggggatacaatgacaacagctgtatatttaatatcaaatgtcatggagagaaaggcacccggatagaaaataaactaggctcagcaacagcaaacccttacttggtgctggctgcaactgttgctgccggcttagatggacttcatagcagtaatgaggtcttggctggtccagatgagagcacagacttttaccaagtggaaccttctgagatccctttaaaactagaagatgcccttgtggcactggaagaagatcaatgcctgagacaggctctaggagaaacctttattcgatattttgttgccatgaagaaatatgagttggagaatgaagaaatagctgcagagagaaataaattcttagagtattttatttagaatagagctcacaactactcctttagacatgtaattgttacttaaagctaatctaccaaaacaaaaagactgaacttttgtaattaacaacagcaacaataacaagattacgaatgcttttgacttttttttttgtccatggaatatttgacagatgaagtaggactgctgagaagattctgataacagaaacaaacaacaaagttgtggtgaagctataatatgcaaacttaccagatcttgtcagtcatttcctatgtgtatgttgacctggataagaatatccaattttgggtggcaataaatatattcgcacattaagaaaaaaaagacttaagcattagaaagcaaaatttaaatgactaaaaaagaaaaaaaagaaaaggagaaaaaattttaatggtacacataggttatgatttccagggagacaaatatactaatatagtctcgctaatcaaataatattgtgaatccaggttgtatgcaccattatggtctttctaaacaagttaaataaacttttgccaaaatataatgacaggtaggcagttttcccctaagtctcttctcttttcacccttctccactagctcctgaaaagcttatgaacttcaaggttataatgtcctcaagaaacaaatccctaaggaatagaattggagctgagaacaacgaggtcagattttaaaagtagttaaagcctttcttttaacaatgcctcatatagaagttcaatacacaaagtatagatagaaagatgtttgtgtgtgagggtaggtgggctctgtctactctgcttcattctttgaaactagatgttcctctgaaacctctagtgctctgtggagtgtgagaacaactgcctggctagccagggctatgtttggagtttaagtttgttattcaaattactgaatctgctgctcacagaggttggtacctccccagagaatattacctgttccaggcctttgtttgaatgagataatattgtaactatcacaaaagtttagctgcttttgggaagaagtccaaaatccacttactagcaaatgaaacattattctactgcttaggatcaaacagcagattttatgttcaattaaaactgactgtagtctcaatttagatagcaattgcacaagcagaggattagaatttggctcagatcctcttattaaaattcatattactcagtagcttaaatagtgaaagtcagtctatccttcactaattactcccttcttttttcctttgagcaggagaagtgtgtttggatacataagaagaaagttcccagcactttgggaggccaaggcaggaggattgcttgaggccaggagtttgagtccagcctggaccacatagtgagacccctgtttctacaaaaaaaaaaaaaaaaatgcctcgcatggtggcacatgcctgtagtcccagctacgtgggaggctgagaagggaggatcgcttgagcctgggagtttcaggctgcagtgagccataatcacaccactgcactccagcttgggtgacagagtgagacactgtcttaaaaaaaagagaagaataaaattcatggatgcatatggggtagagagaaagatagtgtagggtagctgggggaaggaagggaacctgtcctgaaacctccagaatgaaatcccacacattacatcatgggagggataaggaagactctcatgccaattttctagctgtctgctagaaaattcccctctgttcattttcccctctgttctcagtaataaaacctcaatatgttctttgaaagcaatgaaaaatgaaatgatatttctgagccttcattaaggttggatgtggtcatgttattaggttcagtgcaaagaggtgaaagtagaagtgttgcatataagttctttaggacattttcttttcttttcttgtattttttttttttttccgagatggagtctcgctttgtcacccaggctgaagtgcaatgtgggggggtcttggctcactgcaacctctgccccctgggttcaagtaattctcctgcctcagcctcccaagtagctgggatcccaggtgcctgctaccatgcctggccttttagtagagatggggtttcaccatattggccagtctggtcttgaactcctgaactcaggtgatcagcctgccttggcctcccaaagtgctaggattacaggcatgagccaccatgccctaccacactttagaacatttttttaaatgacggatgctgtgtgctctgccctttctttctcttgctgccttcacccttcctgctgagtggcctacagataatgtggctaggattatgtccttgggaagggaggtttgctccacagggtacagtaataaggtggaatctctgctttgtagagcagtttgacttgcctacatccagatgtttacctgagagagaaccaaacttctatcttctttaagccacaatgattttgattctttgttagttgcaatgaaatttattttctcttttccatgtgtgtgttgtatgtgtgtttgtgtgtgagtgtgtgcatatgagtggggaatttgagggatttggggatgaaagaacaaaggtataagaaccagtgaaagacgacttcctcaatattcccacttctagagaggataatctgagttaatcaaagggatccacacatccaaaaaatgggattggctctaacccatccctataaagtggcatatccctttatagtccacgggccttaatgaaacatgtctaatgcattgacttcattttaccataatgagtaaagatgctgtaaaaagtctgataatcacagtgtttgaagccgttttttcccctttcgcattattagcataacttaaaaacacagtactcaggatgccatgtgaaggaattatataactaggaatattatcttcagtattaagtgtacagtcgtgagtcaaagaaaatattcagccatagattacaaatcagttgataacgtaagttggtgtggcagtttccaccaagatttcagttaggtgtgtgctgatgtatattcttgttctttaaggcaacccaaaaagaggcattggccagcagagttcagggccaaagacaaattggggtaggtacatgtaaaaatcagttatctatttttctatttctttcatctgttcataggctttctattgttgaaaggactttctgctgatgcttctaccttcttggtctgggttaagagggtcagacattcattcagcagcacttattgagcaccatttgtgtgctaagccttcagctgggagccatcatactaggggagaccaaaacaaagatgagcagacaatgaaagagttttggatctgtgtatcttaagcagaacataaataattttttttgtagacctaatgctgaaaaaagctatttggaaagcttctttatggctcgaaaagggtgccttataaatagctttacaaaaattgctttcttattttcatttactataattgttctaatcaaagcttaggggaaaaatgtgattactgaatttaaagttggtaattaaatgagtatacataagaaatgtaaattaaaagcgataatattttaagactagaaattaaaacattagtattgtagtaacaagtttctattttcaaggacattctataatctaaaatttcattttacagtgtgtgaataacaacaacgcttgaaatgattatttgaaggcaatgaaagatcaaaaaactttaatctgaataaaaattgaaagcatacagtgaagtctgagcttatcagtaaaacagaacagtctattgacatatctccagtcacctgtttgacaaaatacactcaccaatatgtttatgatataggtatgactggacaatacctttaaccttgggttttctatgacaggggtaagaatttgtgtctttaaacattacctatgtgcacagtgccttccctgttaaagctcttctcatgctgcctataattaggggtttacatgatacttcctaattgctaattaggatgtgaattctcagaataaaaggtacagatcttactta

SEQ ID NO: 147809 - DNA, 608 bp, Homo sapiens
  Payload ID: 9243
  Gene Symbol: LGSN
  Gene Name: lengsin, lens protein with glutamine synthetase domain
  ENST ID: ENST00000485906
  CDS Start-End: 35-608
gtggtttctaacgctgaacttaaaaagtgttgagatgaataatgaagaggaccttctgcaggaggactcaacaagagatgaaggcaatgagactgaagccaacagcatgaacacattaagaaggacaaggaagaaagtcactaaaccatatgtttgttcaactgaagtgggagaaacggatatgtccaattcaaatgattgcatgagggacagcagtcaaattttgaccccacctcaactctcttctagaatgaaacacattagacaagccatggccaaaaatcgcctccagtttgtacgatttgaagcaacagacctccacggcgtgtccaggtctaagactatccctgcacacttttttcaagagaaagtgagccatggtgtttgcatgccccgaggttatcttgaagtgataccaaatccaaaggacaatgaaatgaataacataagagccacatgttttaatagcgacatagtcctaatgccagagttatcaacctttagagttttgccatgggctgacagaactgcaagagtgatatgtgataccttcactgtgactgctcctgaaaagcttatgaacttcaaggttataatgtcctcaagaa

SEQ ID NO: 147810 - DNA, 1612 bp, Homo sapiens
  Payload ID: 9243
  Gene Symbol: LGSN
  Gene Name: lengsin, lens protein with glutamine synthetase domain
  Uniprot ID: Q5TDP6
  ENST ID: ENST00000622415
  CDS Start-End: 1-357
atgaataatgaagaggaccttctgcaggaggactcaacaagagatgaaggcaatgagactgaagccaacagcatgaacacattaagaaggacaaggaagaaagtcactaaaccatatgtttgttcaactgaagtgggagaaacggatatgtccaattcaaatgagaggatcagaaaccaaatggtgtgccacaaattagggaacacaagcaaacctatcatgggacctggctctgctgagtctcatctgtcatatgatgacaaggactctcaggatgagacaacagtgataaaacctttgccccccagaacaacaaccaatgttcctggaggtgaatttaacccaaactctgaatgaaacacattagacaagccatggccaaaaatcgcctccagtttgtacgatttgaagcaacagacctccacggcgtgtccaggtctaagactatccctgcacacttttttcaaatccaaaggacaatgaaatgaataacataagagccacatgttttaatagcgacatagtcctaatgccagagttatcaacctttagagttttgccatgggctgacagaactgcaagagtgatatgtgataccttcactgtgactggtgagcctcttttgacttccccaaggtacattgcaaagaggcagctgagccatctgcaggcctctggcttttccctgctttctgctttcatctatgatttttgcatttttggtgtgcccgaaattttaaattcaaagattatatcttttcctgctttaacatttttaaataaccatgatcagcccttcatgcaggaacttgttgatggcttgtatcacactggagccaatgtcgagagtttttcctcctctaccaggcctggtcagatggaaatctctttcctgcctgaatttggcattagctcagctgataatgcatttaccctcagaacaggtgtcaaagaagtggcaaggaaatataattacattgccagcttcttcattgagactggattttgtgattcagggattttgtctcatagtctctgggatgtcgataggaagaaaaacatgttctgcagcacttctggaactgagcagctcacgatcactgggaaaaaatggttggcaggactcttgaagcactctgctgcgctcagctgcctgatggcgccttctgttagctgccgaaagcgttattccaaggacaggaaagacctgaagaagagtgtgcctacaacatggggatacaatgacaacagctgtatatttaatatcaaatgtcatggagagaaaggcacccggatagaaaataaactaggctcagcaacagcaaacccttacttggtgctggctgcaactgttgctgccggcttagatggacttcatagcagtaatgaggtcttggctggtccagatgagagcacagacttttaccaagtggaaccttctgagatccctttaaaactagaagatgcccttgtggcactggaagaagatcaatgcctgagacaggctctaggagaaacctttattcgatattttgttgccatgaagaaatatgagttggagaatgaagaaatagctgcagagagaaataaattcttagagtattttatttag

SEQ ID NO: 147811 - DNA, 649 bp, Homo sapiens
  Payload ID: 9244
  Gene Symbol: LENEP
  Gene Name: lens epithelial protein
  Uniprot ID: Q9Y5L5
  ENST ID: ENST00000368427
  CDS Start-End: 23-208
cttcctcggaactgttgcccacatgcagccccggacacagcccctagcccaaaccctacccttcttcctcggaggggcccctcgagacactgggctgcgggtgcctgtcattaagatgggcacagggtgggagggcttccagcggaccctgaaggaagtcgcctacatcctcctctgctgctggtgtatcaaggaactgctggattaatggtagcagggaactgcctcctctccccaccagcaccatggctggcatcgctcagcccccagcccaattgccatcaagactcctgaagccagctgtgcttgaccaaggatgggccataaacaatgagtaaacagtaaagtgtggatcctgctttgagctgtgtcatctagcagacctgcctcatctctgagcctccttcattcccaacccctgcctctggtggacctctggtgggcaggagcttggactgctctggctaggaccccagtaagattgtggcaagacctggcactcctccaagcttggcacagtgagcccaccagctcagatggttgatcttaccataccctcatagtaccaagaatggactgccccctaagaaacctgtttgagaatcactgaattataaatataatccataggccttgaggcccaagatta

SEQ ID NO: 147812 - DNA, 555 bp, Homo sapiens
  Payload ID: 9244
  Gene Symbol: LENEP
  Gene Name: lens epithelial protein
  Uniprot ID: Q9Y5L5
  ENST ID: ENST00000392487
  CDS Start-End: 21-206
tcctcggaactgttgcccacatgcagccccggacacagcccctagcccaaaccctacccttcttcctcggaggggcccctcgagacactgggctgcgggtgcctgtcattaagatgggcacagggtgggagggcttccagcggaccctgaaggaagtcgcctacatcctcctctgctgctggtgtatcaaggaactgctggattaatggtagcagggaactgcctcctctccccaccagcaccatggctggcatcgctcaggtgggcagggtagagtaaacaggaggcatagctgcagcttctgtggcagagcttgccttagcttctcattctcttctttagcccccagcccaattgccatcaagactcctgaagccagctgtgcttgaccaaggatgggccataaacaatgagtaaacagtaaagtgtggatcctgctttgagctgtgtcatctagcagacctgcctcatctctgagcctccttcattcccaacccctgcctctggtggacctctggtgggcaggagcttggactgctctggctaggaccccag

SEQ ID NO: 147813 - DNA, 983 bp, Homo sapiens
  Payload ID: 9245
  Gene Symbol: LIM2
  Gene Name: lens intrinsic membrane protein 2, 19kDa
  Uniprot ID: P55344
  ENST ID: ENST00000221973
  CDS Start-End: 44-691
tggcagaaggagggctcgggcaggctctgccactcagatcaccatgtacagcttcatgggtggtggcctgttctgtgcctgggtggggaccatcctcctggtggtggccatggcaacagaccactggatgcagtaccggctgtcagggtccttcgcccaccagggcctgtggcggtactgcctgggcaacaagtgctacctgcagacagacagcatcggtgagccccccggccagggtccaggccgcgcctggggaaagagcagggcggacctcggggcccaaggacacctgtattccagatggagaactctgcggctcaaagagggaaagggagcaacccaagcatactggaatgccacccgggccttcatgatcctgtctgccctatgcgccatctccggcatcatcatgggcatcatggccttcgctcatcagcctaccttctcccgcatctcccggcccttctctgctggcatcatgtttttttcctcaacccttttcgtcgtgttggccttggccatctacactggagtcaccgtcagcttcctgggccgccgctttggggactggcgcttttcctggtcctacatcctgggctgggtggcagtgctcatgacgttcttcgcagggattttctacatgtgcgcctaccgggtgcatgaatgccggcgcctgtctacaccccgctgagcccaaatgtgtcccccaacttcatctggaagttaaagtgaggccactgaagaggaggaggagggtctagaggcctgaaatcctggttcctaggggaatgagggggctcagttctggactgtgggtttgtggggggaggctgactcctggtcctaggctggaaggaggaagaatagggcccatgggagggagctgagaagactcaagtccccgtctgcctggcaggttgttagaaaaatggactatccattagagcaactttctggggcctaataaaactgatgtgaaacta

SEQ ID NO: 147814 - DNA, 861 bp, Homo sapiens
  Payload ID: 9245
  Gene Symbol: LIM2
  Gene Name: lens intrinsic membrane protein 2, 19kDa
  Uniprot ID: P55344
  ENST ID: ENST00000596399
  CDS Start-End: 49-570
ggccgtggcagaaggagggctcgggcaggctctgccactcagatcaccatgtacagcttcatgggtggtggcctgttctgtgcctgggtggggaccatcctcctggtggtggccatggcaacagaccactggatgcagtaccggctgtcagggtccttcgcccaccagggcctgtggcggtactgcctgggcaacaagtgctacctgcagacagacagcatcgcatactggaatgccacccgggccttcatgatcctgtctgccctatgcgccatctccggcatcatcatgggcatcatggccttcgctcatcagcctaccttctcccgcatctcccggcccttctctgctggcatcatgtttttttcctcaacccttttcgtcgtgttggccttggccatctacactggagtcaccgtcagcttcctgggccgccgctttggggactggcgcttttcctggtcctacatcctgggctgggtggcagtgctcatgacgttcttcgcagggattttctacatgtgcgcctaccgggtgcatgaatgccggcgcctgtctacaccccgctgagcccaaatgtgtcccccaacttcatctggaagttaaagtgaggccactgaagaggaggaggagggtctagaggcctgaaatcctggttcctaggggaatgagggggctcagttctggactgtgggtttgtggggggaggctgactcctggtcctaggctggaaggaggaagaatagggcccatgggagggagctgagaagactcaagtccccgtctgcctggcaggttgttagaaaaatggactatccattagagcaactttctggggcctaataaaactgatgtgaaact

SEQ ID NO: 147815 - DNA, 2193 bp, Homo sapiens
  Payload ID: 9246
  Gene Symbol: LEO1
  Gene Name: LEO1 homolog, Paf1/RNA polymerase II complex component
  Uniprot ID: Q8WVC0
  ENST ID: ENST00000299601
  CDS Start-End: 62-2062
cgtgccgtaaagagaggccgggagctgcccctaaccgaggcagcagcggacgtgagcgataatggcggatatggaggatctcttcgggagcgacgccgacagcgaagctgagcgtaaagattctgattctggatctgactcagattctgatcaagagaatgctgcctctggcagtaatgcctctggaagtgaaagtgatcaggatgaaagaggtgattcaggacaaccaagtaataaggaactgtttggagatgacagtgaggacgagggagcttcacatcatagtggtagtgataatcactctgaaagatcagacaatagatcagaagcttctgagcgttctgaccatgaggacaatgacccctcagatgtagatcagcacagtggatcagaagcccctaatgatgatgaagacgaaggtcatagatcggatggagggagccatcattcagaagcagaaggttctgaaaaagcacattcagatgatgaaaaatggggcagagaagataaaagtgaccagtcagatgatgaaaagatacaaaattctgatgatgaggagagggcacaaggatctgatgaagataagctgcagaattctgacgatgatgagaaaatgcagaacacagatgatgaggagaggcctcagctttccgatgatgagagacaacagctatctgaggaggaaaaggctaattctgatgatgaacggccggtagcttctgataatgatgatgagaaacagaattctgatgatgaagaacaaccacagctgtctgatgaagagaaaatgcaaaattctgatgatgaaaggccacaggcctcagatgaagaacacaggcattcagatgatgaagaggaacaggatcataaatcagaatctgcaagaggcagtgatagtgaagatgaagttttacgaatgaaacgcaagaatgcgattgcatctgattcagaagcggatagtgacactgaggtgccaaaagataatagtggaaccatggatttatttggaggtgcagatgatatctcttcagggagtgatggagaagacaaaccacctactccaggacagcctgttgatgaaaatggattgcctcaggatcaacaggaagaggagccaattcctgagaccagaatagaagtagaaatacccaaagtaaacactgatttaggaaacgacttatattttgttaaactgcccaactttctcagtgtagagcccagaccttttgatcctcagtattatgaagatgaatttgaagatgaagaaatgctggatgaagaaggtagaaccaggttaaaattaaaggtagaaaatactataagatggaggatacgccgagatgaagaaggaaatgaaattaaagaaagcaatgctcggatagtcaagtggtcagatggaagcatgtccctgcatttaggcaatgaagtgtttgatgtgtacaaagccccactgcagggcgaccacaatcatctttttataagacaaggtactggtctacagggacaagcagtctttaaaacgaaactcaccttcagacctcactctacggacagtgccacacatagaaagatgactctgtcacttgcagataggtgttcaaagacacagaagattagaatcttgccaatggctggtcgtgatcctgaatgccaacgcacagaaatgattaagaaagaagaagaacgtttgagggcttccatacgtagggaatctcagcagcgccgaatgagagagaaacagcaccagcgggggctgagcgccagttacctggaacctgatcgatacgatgaggaggaggaaggcgaggagtccatcagcttggctgccattaaaaaccgatataaagggggcattcgagaggaacgagccagaatctattcatcagacagtgatgagggatcagaagaagataaagctcaaagattactcaaagcaaagaaacttaccagtgatgaggaaggtgaaccttccggaaagagaaaagcagaagatgatgataaagcaaataaaaagcataagaagtatgtgatcagcgatgaagaggaagaagatgatgattgaagtatgaaatatgaaaacattttatatattttattgtacagttataaatatgtaaacatgagttattttgattgaaatgaatcgatttgcttttgtgtaattttaattgtaataaaacaatttaaaagcaa

SEQ ID NO: 147816 - DNA, 1981 bp, Homo sapiens
  Payload ID: 9246
  Gene Symbol: LEO1
  Gene Name: LEO1 homolog, Paf1/RNA polymerase II complex component
  Uniprot ID: Q8WVC0
  ENST ID: ENST00000315141
  CDS Start-End: 32-1852
ctaaccgaggcagcagcggacgtgagcgataatggcggatatggaggatctcttcgggagcgacgccgacagcgaagctgagcgtaaagattctgattctggatctgactcagattctgatcaagagaatgctgcctctggcagtaatgcctctggaagtgaaagtgatcaggatgaaagaggtgattcaggacaaccaagtaataaggaactgtttggagatgacagtgaggacgagggagcttcacatcatagtggtagtgataatcactctgaaagatcagacaatagatcagaagcttctgagcgttctgaccatgaggacaatgacccctcagatgtagatcagcacagtggatcagaagcccctaatgatgatgaagacgaaggtcatagatcggatggagggagccatcattcagaagcagaaggttctgaaaaagcacattcagatgatgaaaaatggggcagagaagataaaagtgaccagtcagatgatgaaaagatacaaaattctgatgatgaggagagggcacaaggatctgatgaagataagctgcagaattctgacgatgatgagaaaatgcagaacacagatgatgaggagaggcctcagctttccgatgatgagagacaacagctatctgaggaggaaaaggctaattctgatgatgaacggccggtagcttctgataatgatgatgagaaacagaattctgatgatgaagaacaaccacagctgtctgatgaagagaaaatgcaaaattctgatgatgaaaggccacaggcctcagatgaagaacacaggcattcagatgatgaagaggaacaggatcataaatcagaatctgcaagaggcagtgatagtgaagatgaagttttacgaatgaaacgcaagaatgcgattgcatctgattcagaagcggatagtgacactgaggtgccaaaagataatagtggaaccatggatttatttggaggtgcagatgatatctcttcagggagtgatggagaagacaaaccacctactccaggacagcctgttgatgaaaatggattgcctcaggatcaacaggaagaggagccaattcctgagaccagaatagaagtagaaatacccaaagtaaacactgatttaggaaacgacttatattttgttaaactgcccaactttctcagtgtagagcccagcatgtccctgcatttaggcaatgaagtgtttgatgtgtacaaagccccactgcagggcgaccacaatcatctttttataagacaaggtactggtctacagggacaagcagtctttaaaacgaaactcaccttcagacctcactctacggacagtgccacacatagaaagatgactctgtcacttgcagataggtgttcaaagacacagaagattagaatcttgccaatggctggtcgtgatcctgaatgccaacgcacagaaatgattaagaaagaagaagaacgtttgagggcttccatacgtagggaatctcagcagcgccgaatgagagagaaacagcaccagcgggggctgagcgccagttacctggaacctgatcgatacgatgaggaggaggaaggcgaggagtccatcagcttggctgccattaaaaaccgatataaagggggcattcgagaggaacgagccagaatctattcatcagacagtgatgagggatcagaagaagataaagctcaaagattactcaaagcaaagaaacttaccagtgatgaggaaggtgaaccttccggaaagagaaaagcagaagatgatgataaagcaaataaaaagcataagaagtatgtgatcagcgatgaagaggaagaagatgatgattgaagtatgaaatatgaaaacattttatatattttattgtacagttataaatatgtaaacatgagttattttgattgaaatgaatcgatttgcttttgtgtaattttaattgtaataaaacaatttaaaagc

SEQ ID NO: 147817 - DNA, 3420 bp, Homo sapiens
  Payload ID: 9247
  Gene Symbol: LEP
  Gene Name: leptin
  Uniprot ID: P41159
  ENST ID: ENST00000308868
  CDS Start-End: 52-555
atcgcagcgccagcggttgcaaggcccaagaagcccatcctgggaaggaaaatgcattggggaaccctgtgcggattcttgtggctttggccctatcttttctatgtccaagctgtgcccatccaaaaagtccaagatgacaccaaaaccctcatcaagacaattgtcaccaggatcaatgacatttcacacacgcagtcagtctcctccaaacagaaagtcaccggtttggacttcattcctgggctccaccccatcctgaccttatccaagatggaccagacactggcagtctaccaacagatcctcaccagtatgccttccagaaacgtgatccaaatatccaacgacctggagaacctccgggatcttcttcacgtgctggccttctctaagagctgccacttgccctgggccagtggcctggagaccttggacagcctggggggtgtcctggaagcttcaggctactccacagaggtggtggccctgagcaggctgcaggggtctctgcaggacatgctgtggcagctggacctcagccctgggtgctgaggccttgaaggtcactcttcctgcaaggactacgttaagggaaggaactctggcttccaggtatctccaggattgaagagcattgcatggacaccccttatccaggactctgtcaatttccctgactcctctaagccactcttccaaaggcataagaccctaagcctccttttgcttgaaaccaaagatatatacacaggatcctattctcaccaggaagggggtccacccagcaaagagtgggctgcatctgggattcccaccaaggtcttcagccatcaacaagagttgtcttgtcccctcttgacccatctccccctcactgaatgcctcaatgtgaccaggggtgatttcagagagggcagaggggtaggcagagcctttggatgaccagaacaaggttccctctgagaattccaaggagttccatgaagaccacatccacacacgcaggaactcccagcaacacaagctggaagcacatgtttatttattctgcattttattctggatggatttgaagcaaagcaccagcttctccaggctctttggggtcagccagggccaggggtctccctggagtgcagtttccaatcccatagatgggtctggctgagctgaacccattttgagtgactcgagggttgggttcatctgagcaagagctggcaaaggtggctctccagttagttctctcgtaactggtttcatttctactgtgactgatgttacatcacagtgtttgcaatggtgttgccctgagtggatctccaaggaccaggttattttaaaaagatttgttttgtcaagtgtcatatgtaggtgtctgcacccaggggtggggaatgtttgggcagaagggagaaggatctagaatgtgttttctgaataacatttgtgtggtgggttctttggaaggagtgagatcattttcttatcttctgcaattgcttaggatgtttttcatgaaaatagctctttcaggggggttgtgaggcctggccaggcaccccctggagagaagtttctggccctggctgaccccaaagagcctggagaagctgatgctttgcttcaaatccatccagaataaaacgcaaagggctgaaagccatttgttggggcagtggtaagctctggctttctccgactgctagggagtggtctttcctatcatggagtgacggtcccacactggtgactgcgatcttcagagcaggggtccttggtgtgaccctctgaatggtccagggttgatcacactctgggtttattacatggcagtgttcctatttggggcttgcatgccaaattgtagttcttgtctgattggctcacccaagcaaggccaaaattaccaaaaatcttggggggtttttactccagtggtgaagaaaactcctttagcaggtggtcctgagacctgacaagcactgctaggcgagtgccaggactccccaggccaggccaccaggatggcccttcccactggaggtcacattcaggaagatgaaagaggaggtttggggtctgccaccatcctgctgctgtgtttttgctatcacacagtgggtggtggatctgtccaaggaaacttgaatcaaagcagttaactttaagactgagcacctgcttcatgctcagccctgactggtgctataggctggagaagctcacccaataaacattaagattgaggcctgccctcagggatcttgcattcccagtggtcaaaccgcactcacccatgtgccaaggtggggtatttaccacagcagctgaacagccaaatgcatggtgcagttgacagcaggtgggaaatggtatgagctgaggggggccgtgcccaggggcccacagggaaccctgcttgcactttgtaacatgtttacttttcagggcatcttagcttctattatagccacatccctttgaaacaagataactgagaatttaaaaataagaaaatacataagaccataacagccaacaggtggcaggaccaggactatagcccaggtcctctgatacccagagcattacgtgagccaggtaatgagggactggaaccagggagaccgagcgctttctggaaaagaggagtttcgaggtagagtttgaaggaggtgagggatgtgaattgcctgcagagagaagcctgttttgttggaaggtttggtgtgtggagatgcagaggtaaaagtgtgagcagtgagttacagcgagaggcagagaaagaagagacaggagggcaagggccatgctgaagggaccttgaagggtaaagaagtttgatattaaaggagttaagagtagcaagttctagagaagaggctggtgctgtggccagggtgagagctgctctggaaaatgtgacccagatcctcacaaccacctaatcaggctgaggtgtcttaagccttttgctcacaaaacctggcacaatggctaattcccagagtgtgaaacttcctaagtataaatggttgtctgtttttgtaacttaaaaaaaaaaaaaaaagtttggccgggtgcggtggctcacgcctgtaatcccagcactttgggaggccaaggtggggggatcacaaggtcactagatggcgagcatcctggccaacatggtgaaaccccgtctctactaaaaacacaaaagttagctgagcgtggtggcgggcgcctgtagtcccagccactcgggaggctgagacaggagaatcgcttaaacctgggaggcggagagtacagtgagccaagatcgcgccactgcactccggcctgatgacagagcgagattccgtcttaaaaaaaaaaaaaaaaaagtttgtttttaaaaaaatctaaataaaataactttgccccctg

SEQ ID NO: 147818 - DNA, 8227 bp, Homo sapiens
  Payload ID: 9248
  Gene Symbol: LEPR
  Gene Name: leptin receptor
  Uniprot ID: P48357
  ENST ID: ENST00000349533
  CDS Start-End: 186-3683
ccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatgggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagccagaaacgtttgagcatctttttatcaagcatacagcatcagtgacatgtggtcctcttcttttggagcctgaaacaatttcagaagatatcagtgttgatacatcatggaaaaataaagatgagatgatgccaacaactgtggtctctctactttcaacaacagatcttgaaaagggttctgtttgtattagtgaccagttcaacagtgttaacttctctgaggctgagggtactgaggtaacctatgaggacgaaagccagagacaaccctttgttaaatacgccacgctgatcagcaactctaaaccaagtgaaactggtgaagaacaagggcttataaatagttcagtcaccaagtgcttctctagcaaaaattctccgttgaaggattctttctctaatagctcatgggagatagaggcccaggcattttttatattatcagatcagcatcccaacataatttcaccacacctcacattctcagaaggattggatgaacttttgaaattggagggaaatttccctgaagaaaataatgataaaaagtctatctattatttaggggtcacctcaatcaaaaagagagagagtggtgtgcttttgactgacaagtcaagggtatcgtgcccattcccagccccctgtttattcacggacatcagagttctccaggacagttgctcacactttgtagaaaataatatcaacttaggaacttctagtaagaagacttttgcatcttacatgcctcaattccaaacttgttctactcagactcataagatcatggaaaacaagatgtgtgacctaactgtgtaatttcactgaagaaaccttcagatttgtgttataatgggtaatataaagtgtaatagattatagttgtgggtgggagagagaaaagaaaccagagtcaaatttgaaaataattgttccaaatgaatgttgtctgtttgttctctcttagtaacatagacaaaaaatttgagaaagccttcataagcctaccaatgtagacacgctcttctattttattcccaagctctagtgggaaggtcccttgtttccagctagaaataagcccaacagacaccatcttttgtgagatgtaattgttttttcagagggcgtgttgttttacctcaagtttttgttttgtaccaacacacacacacacacacattcttaacacatgtccttgtgtgttttgagagtatattatgtatttatattttgtgctatcagactgtaggatttgaagtaggactttcctaaatgtttaagataaacagaattcagccctggcctaaggggttatacttgtgaagactaatgagccaattgttatgtaccaaatctaagatatgtaccatagaatgaaataacctgcaagaatggtgatgcccacaatcagtattttgatgacaacacaagcacttttgaaaacataatgtcagttttaattcttctctctgaaagatgttgaagtggtcactttctgataaagttagattgccaaatgtcactgtatatctctccggaataattgtcttcccccatccccacctggacatatcctattttttcccctcactgagcattctgtctacataaaccaaccactgtgcagtactttacataccttaacccagttaattattgaaataattgtatgagacatctgttactatgatactccttaaagatgaagacagtaaataatttgcccacagttacagtcagtgggtgatggaatcagagttcagatttaaatccagattttttaatgctaatgattatgtttttaacctataccctacatagccatcaatttaaaaaaactgacttgtaatcaaaatttattaagtagaggctggcacagtggtgcatgcctgtaatcccagcactttgggaggctgaggcgggtggatcgcttgagctcagaagtcttgaaactagccggggcaacatagtgaggcctcgtctctacaaaaaacacaaaaattagctgagtgtgacagaaaaaataaagattataaaatgtattaagtagaagtataatgctggatgagaaattaagtgagaattgcacagatctcatgtttgcctttaacaacttaagattaatacataagtttattatttattcaacttttggtacggtaaaaaaattcaaagacagcatattgggcaacaaactaaattaagaaacctgcacatttggatgttcagtggcaagaagaccttcaagaatatcagtatcatcaaaataagtactttagtgttcaaaaatatgcctatgggtttttaaaaattatcagaatttcatatttagaccgagacaagagactcccaattttactgttatcctaaataaatctctacattccatctctagtccagttgtggctatgaagtgagcagttctaaacaatgacaaagattccagaccccacttgatagatatttttcacactttataatcaatttccactcaggaatcaataaagttattccatgtcataagtatttttaagatgtctcaggatctcacatactcaactaatgacccccttacaagaaataggtaaagggctgatagcaactcattacttgatgtggtacgagagccttagttctatgcaaagataaatggagaagcgtttttttcatggataattttacatggctttagagacacagaaacagataaattattacatgtataaaaattttagtaaaattgacattttaaatacatgcttatagattattggtatttaattgaaggtacagtacagaagagatagaaaaataaattttgccccactctgaaattgaagactgacctctgagcatgtccgctgagacacagtattctcctgtgatctgggacccagaataacaggaaagagaaactgatagatgttttcatcagcccaaggatgtatgtatcttacttgagtgaattcaacagtcccaggaccactgtagtgctgtaggtctgtgtaaagaaatgtagtgacagcacattaacctgagatcattgataccatcttggttcagcctcagttccccagataagtgaacaaatgaacaaaaatgcacttcagaaatattgaaattccaaggcactatttcatggacagtgctgaacaagtatagtttggcctattggtatgtatagacttagatcatatttattgtcaatgggcttgaattctgatttccacttttgaaagtttatttcactatgtatcattacattttattgggaccttgtgaaaactacctgccatgaaatactggattttcacataatttagaaaaaatttagaatgttttatgcctcagaatggtcaggaacttcccatttcttcccacagcttctataaaaaaaatttaaaaggaaggaggagctgaaataggggctatggtcttttaaacttataaatctggaatttttaatatttcattttaaggccttaaaccgaaacacaagctactaatcagtctttctaaatctgaccttcattgaaagcaactcagaaattaataatttgtgctgtggcttcaagtttaaatagattgtttgaagagaaatcatatgtcagggtttgcaggattacaggatttctaacttaaacccccaagaacaatgaaaaagttgacgtacatgtcactatgaataggcaccttctgttggatctctgtgtccatttagagatgagctacaagttgacaagaaaaataggagcagttttttttttctttttaaacctagtcaccaaatggtaaaaggacttggatgaaattccaataccagtgtgagattctggatttagaataaggttttataaccttaggcatgtcattcttctacttctcatttttccctaataaaacttattctctcttccataatatcatatatatggtcacattacttcaggaatatttatattacctcctccaaaactgaaagaaaataaactttaggctgtaagagttgagaattatgcatacagggctcacaggcggagttggacaatatgctgatggatcaagacatactgcaaccacaaagttccatctcacttagatgtggatgaaaaaagatctcttgctaaattattttctgtgaccttaaaagaaatttgtttcacttttcatctttcaagggtcatcttgatagttaccttaacaaacctttctcagctatttattattgagaaagcccattcttaaattttaagtcacaaaattatagttgtccactctactatgactgaaagaagcagcattcaagaaaaaatttaaacatagttaccaagaaatgtgaagaagtatttataaaaggaagctacataagtaggtaattttactctttcttaaccagtttaaaacagtaaagcacacctgcatctaatcacaatgttaggcgaacaacttaaaacatgatcagcctgtatgagaactgggatattgttacatattcagcctgtatgagaactgggatattgttgttacatgtatttgtataaacattaggagatgatttccatggcttttttttttttttttttaggaagtcttgctctgttgcccagctggagtgcagtgatgtgatctcggctcactgcaacccctgcttcccaggttcaagcgattctcctgcctcagcctccccagtagctgggattacgggcacaccaccatgcccagcttttatttatttatttatttattttggatttttagtagagatggggttttgccctgttggccaggctggtcttgaactcctgacctcaagtgatccgccctcattggcctcccaaagttctgggattacaggtgtgagagctgccgcgcctagcccttcatgaggttttatagtgaatgaattatttttctataaagtttatcaatatttattttggaaagctgctgaaaatgtctttttcaaaattaattatgcttaagatgtatggcattaaattcaattttatgaggctttctgacatatttactaaaaaaacctggaactgagactgaatttggaagacatttaattttgtagtgagatatctatattgtagatattgtacttttaaaacctgtcattaagtgtttggcatgtggttaatactttctctttagtcacaactggtattttaataaatgttataaacgtaagtgccaagatatgcatcactaactgttctatgaaatttgtctacttctcctttatgttcccaaagtcacagagaaagcagtgtactttatgacagtatatttatctttttatcattatgaattataagcagtgttaattttgagaaataaaagtccaaaaagaa

SEQ ID NO: 147819 - DNA, 2935 bp, Homo sapiens
  Payload ID: 9248
  Gene Symbol: LEPR
  Gene Name: leptin receptor
  Uniprot ID: P48357
  ENST ID: ENST00000344610
  CDS Start-End: 151-2871
accttgggcgaggagttcggagcggccccatcgcagagcccacggccagccgagcgcgcgcgacgcaggtgcccgagccccggcgccgccgccatctctgccttcggtcgagttggacccccggatcaaggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagaaaatgcctggcacaaaggaactactgggtggaggttggttgacttaggaaatgcttgtagactacgtcctacctcgctgccgcacctgctctccctgaggtgtgcacaatg

SEQ ID NO: 147820 - DNA, 2805 bp, Homo sapiens
  Payload ID: 9248
  Gene Symbol: LEPR
  Gene Name: leptin receptor
  Uniprot ID: P48357
  ENST ID: ENST00000371058
  CDS Start-End: 21-2741
gtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagaaaatgcctggcacaaaggaactactgggtggaggttggttgacttaggaaatgcttgtagactacgtcctacctcgctgccgcacctgctctccctgaggtgtgcacaatg

SEQ ID NO: 147821 - DNA, 3079 bp, Homo sapiens
  Payload ID: 9248
  Gene Symbol: LEPR
  Gene Name: leptin receptor
  Uniprot ID: P48357
  ENST ID: ENST00000371059
  CDS Start-End: 186-3062
ccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatgggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagatgcttgaaggcagcatgttcgttaagagtcatcaccactccctaatctcaagtacccagggacacaaacactgcggaaggccacagggtcctctgcataggaaaaccagagacctttgttcacttgtttatctgctgaccctccctccactattgtcctatgaccctgccaaatccccctctgtgagaaacacccaagaatgatcaataaaaaaaaaaaa

SEQ ID NO: 147822 - DNA, 5135 bp, Homo sapiens
  Payload ID: 9248
  Gene Symbol: LEPR
  Gene Name: leptin receptor
  Uniprot ID: P48357
  ENST ID: ENST00000371060
  CDS Start-End: 186-2876
ccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatgggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagagaacggacattctttgaagtctaatcatgatcactacagatgaacccaatgtgccaacttcccaacagtctatagagtattagaagatttttacattttgaagaaggggagcaaatctaaaaaaaattcagttgaacttctgagagttaacatatggtggattatgttgatttagaacttaaaatagatgtgtaaatttgggttcaaaatgtagatttgagtccagtttggatgtgtgattaattttcaaatcatctaaagtttaaaagtagtattcatgatttctggcttttgatttgtcatattcctggtcataaaacattaagaaaattatggctgttgctgtcattacatatctattaaatgtcatcaaatatgtagtagacaatgctgtaattaggtgaactctaaaactgcaacatctgacaaatagctttaaaaatacaatgattataagtatggaatcagtgaaaatatttagtttgtatttttatgtccaaacttttccattttagattcctttatagacacgtcagcctaaaaatcagcctattcgggtgttcttttgaatatctcctggcatttttgtatctaactttgttcaatctgggaatttcagttttcaatatccttgaaaatggcttaagtgataacttccgtttcagttaaaaggaagcccgaagttgtgtttgtgctgcccacaggacagtgggagttacagttcatatcaggatgaccctacatacccaggtcagattgacgggaccagaagggaacatcgacttctaatccagctttcttgtttaattatgacctaaatctaatttacttccactgaaccatccaagacctctggcaggcagggaaatgggcagtgatgcaaaaaagggagactctttggagcttttatgaatagttcatggtgaggacagaacttttctactttcagacagactgcttgctagttttatgaattcagcacacgaattatgctgcgttgctcacattcaaaccaaaccaacgactatgtttaatgaactcagtattcaaatttattatatatgcgtatatatgtatatatggatcccttatatttagatttaactcgtagttttatttgaaagtagaaaagaactctacaaaaacgggaagaatgtgtctttcttcccttcttgacttctaataggtgtcattgaaatgtaaaatctaagtatgaaattatgaaaggacattctttaattactgcccactcaacacatatttaatatgtgcccagattattctaaaatcttaaaaaaagatgcatatagtgaaattttttaaatggatatacttttaataaagttttataactcactgacaaaacatatttcaatagtatatgagtatgagatttcttatcaattatgagtgaaatattctatctgaatgcattggaaggcatttacagtatttgctttcaacagttactgagtatgacattttagcatgaaatatatcaaacacatcatttgaaggacatatgtaatcttgactatggttatggtttttttgtatgtattccttgttttcatattgatagcatctaattcttttgacaatcttaatatgtaggttcatttaaattttaagacagttcagtgcatatatagtagaagccttaagaaaaaagaaaatgagcaagcaaatatttgaagaaatgtataaaaccatagatttctttcagaaaaaaaaaacaggcataggaacagttttctcttcatatattatgattatgaataataggaaagttgtattaattcagtatttgtcattatgcagtattttaatacctacataagtctattccattattatattttgcgcttggcatatttattcctttatgcttttaatcactaacatattttacttaagagtataaaactatgctaaataaattgtattgtatatggaatatgcttgccattatgaagaacagctgggtataccattatttcaagtaataaatctgaattctattagtttaaaaattgtaaaattcaagttaaatgacgtgtatgatatataagctgaacacattttctatagcccttaatttagttgtgttaatttttcaaggtgatgtatcaacagctttttttattttgcatttgttttttcaatgtgtttacattgtatgaattgagctttttgcccacagattcttgatttgtagttgtttggcaggatttttctttgtgatataatcacttctataaaaaatatgatgtaca

SEQ ID NO: 147823 - DNA, 1523 bp, Homo sapiens
  Payload ID: 9248
  Gene Symbol: LEPR
  Gene Name: leptin receptor
  ENST ID: ENST00000406510
  CDS Start-End: 738-1436
gagacatggcgggcgttaaagctctcgtggcattatccttcagtggggctattggactgacttttcttatgctgggatgtgccttagaggattatgggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctccagaaacgtttgagcatctttttatcaagcatacagcatcagtgacatgtggtcctcttcttttggagcctgaaacaatttcagaagatatcagtgttgatacatcatggaaaaataaagatgagatgatgccaacaactgtggtctctctactttcaacaacagatcttgaaaagggttctgtttgtattagtgaccagttcaacagtgttaacttctctgaggctgagggtactgaggtaacctatgaggacgaaagccagagacaaccctttgttaaatacgccacgctgatcagcaactctaaaccaagtgaaactggtgaagaacaagggcttataaatagttcagtcaccaagtgcttctctagcaaaaattctccgttgaaggattctttctctaatagctcatgggagatagaggcccaggcattttttatattatcagatcagcatcccaacataatttcaccacacctcacattctcagaaggattggatgaacttttgaaattggagggaaatttccctgaagaaaataatgataaaaagtctatctattatttaggggtcacctcaatcaaaaagagagagagtggtgtgcttttgactgacaagtcaagggtatcgtgcccattcccagccccctgtttattcacggacatcagagttctccaggacagttgctcacactttgtagaaaataatatcaacttaggaacttctagtaagaagacttttgcatcttacatgcctcaattccaaacttgttctactcagactcataagatcatggaaaacaagatgtgtgacctaactgtgtaatttcactgaagaaaccttcagatttgtgttataatgggtaatataaagtgtaatagattatagttgtgggtgggagagagaaaagaa

SEQ ID NO: 147824 - DNA, 5081 bp, Homo sapiens
  Payload ID: 9248
  Gene Symbol: LEPR
  Gene Name: leptin receptor
  Uniprot ID: P48357
  ENST ID: ENST00000616738
  CDS Start-End: 151-2841
accttgggcgaggagttcggagcggccccatcgcagagcccacggccagccgagcgcgcgcgacgcaggtgcccgagccccggcgccgccgccatctctgccttcggtcgagttggacccccggatcaaggtgtacttctctgaagtaagatgatttgtcaaaaattctgtgtggttttgttacattgggaatttatttatgtgataactgcgtttaacttgtcatatccaattactccttggagatttaagttgtcttgcatgccaccaaattcaacctatgactacttccttttgcctgctggactctcaaagaatacttcaaattcgaatggacattatgagacagctgttgaacctaagtttaattcaagtggtactcacttttctaacttatccaaaacaactttccactgttgctttcggagtgagcaagatagaaactgctccttatgtgcagacaacattgaaggaaagacatttgtttcaacagtaaattctttagtttttcaacaaatagatgcaaactggaacatacagtgctggctaaaaggagacttaaaattattcatctgttatgtggagtcattatttaagaatctattcaggaattataactataaggtccatcttttatatgttctgcctgaagtgttagaagattcacctctggttccccaaaaaggcagttttcagatggttcactgcaattgcagtgttcatgaatgttgtgaatgtcttgtgcctgtgccaacagccaaactcaacgacactctccttatgtgtttgaaaatcacatctggtggagtaattttccagtcacctctaatgtcagttcagcccataaatatggtgaagcctgatccaccattaggtttgcatatggaaatcacagatgatggtaatttaaagatttcttggtccagcccaccattggtaccatttccacttcaatatcaagtgaaatattcagagaattctacaacagttatcagagaagctgacaagattgtctcagctacatccctgctagtagacagtatacttcctgggtcttcgtatgaggttcaggtgaggggcaagagactggatggcccaggaatctggagtgactggagtactcctcgtgtctttaccacacaagatgtcatatactttccacctaaaattctgacaagtgttgggtctaatgtttcttttcactgcatctataagaaggaaaacaagattgttccctcaaaagagattgtttggtggatgaatttagctgagaaaattcctcaaagccagtatgatgttgtgagtgatcatgttagcaaagttacttttttcaatctgaatgaaaccaaacctcgaggaaagtttacctatgatgcagtgtactgctgcaatgaacatgaatgccatcatcgctatgctgaattatatgtgattgatgtcaatatcaatatctcatgtgaaactgatgggtacttaactaaaatgacttgcagatggtcaaccagtacaatccagtcacttgcggaaagcactttgcaattgaggtatcataggagcagcctttactgttctgatattccatctattcatcccatatctgagcccaaagattgctatttgcagagtgatggtttttatgaatgcattttccagccaatcttcctattatctggctacacaatgtggattaggatcaatcactctctaggttcacttgactctccaccaacatgtgtccttcctgattctgtggtgaagccactgcctccatccagtgtgaaagcagaaattactataaacattggattattgaaaatatcttgggaaaagccagtctttccagagaataaccttcaattccagattcgctatggtttaagtggaaaagaagtacaatggaagatgtatgaggtttatgatgcaaaatcaaaatctgtcagtctcccagttccagacttgtgtgcagtctatgctgttcaggtgcgctgtaagaggctagatggactgggatattggagtaattggagcaatccagcctacacagttgtcatggatataaaagttcctatgagaggacctgaattttggagaataattaatggagatactatgaaaaaggagaaaaatgtcactttactttggaagcccctgatgaaaaatgactcattgtgcagtgttcagagatatgtgataaaccatcatacttcctgcaatggaacatggtcagaagatgtgggaaatcacacgaaattcactttcctgtggacagagcaagcacatactgttacggttctggccatcaattcaattggtgcttctgttgcaaattttaatttaaccttttcatggcctatgagcaaagtaaatatcgtgcagtcactcagtgcttatcctttaaacagcagttgtgtgattgtttcctggatactatcacccagtgattacaagctaatgtattttattattgagtggaaaaatcttaatgaagatggtgaaataaaatggcttagaatctcttcatctgttaagaagtattatatccatgatcattttatccccattgagaagtaccagttcagtctttacccaatatttatggaaggagtgggaaaaccaaagataattaatagtttcactcaagatgatattgaaaaacaccagagtgatgcaggtttatatgtaattgtgccagtaattatttcctcttccatcttattgcttggaacattattaatatcacaccaaagaatgaaaaagctattttgggaagatgttccgaaccccaagaattgttcctgggcacaaggacttaattttcagaagagaacggacattctttgaagtctaatcatgatcactacagatgaacccaatgtgccaacttcccaacagtctatagagtattagaagatttttacattttgaagaaggggagcaaatctaaaaaaaattcagttgaacttctgagagttaacatatggtggattatgttgatttagaacttaaaatagatgtgtaaatttgggttcaaaatgtagatttgagtccagtttggatgtgtgattaattttcaaatcatctaaagtttaaaagtagtattcatgatttctggcttttgatttgtcatattcctggtcataaaacattaagaaaattatggctgttgctgtcattacatatctattaaatgtcatcaaatatgtagtagacaatgctgtaattaggtgaactctaaaactgcaacatctgacaaatagctttaaaaatacaatgattataagtatggaatcagtgaaaatatttagtttgtatttttatgtccaaacttttccattttagattcctttatagacacgtcagcctaaaaatcagcctattcgggtgttcttttgaatatctcctggcatttttgtatctaactttgttcaatctgggaatttcagttttcaatatccttgaaaatggcttaagtgataacttccgtttcagttaaaaggaagcccgaagttgtgtttgtgctgcccacaggacagtgggagttacagttcatatcaggatgaccctacatacccaggtcagattgacgggaccagaagggaacatcgacttctaatccagctttcttgtttaattatgacctaaatctaatttacttccactgaaccatccaagacctctggcaggcagggaaatgggcagtgatgcaaaaaagggagactctttggagcttttatgaatagttcatggtgaggacagaacttttctactttcagacagactgcttgctagttttatgaattcagcacacgaattatgctgcgttgctcacattcaaaccaaaccaacgactatgtttaatgaactcagtattcaaatttattatatatgcgtatatatgtatatatggatcccttatatttagatttaactcgtagttttatttgaaagtagaaaagaactctacaaaaacgggaagaatgtgtctttcttcccttcttgacttctaataggtgtcattgaaatgtaaaatctaagtatgaaattatgaaaggacattctttaattactgcccactcaacacatatttaatatgtgcccagattattctaaaatcttaaaaaaagatgcatatagtgaaattttttaaatggatatacttttaataaagttttataactcactgacaaaacatatttcaatagtatatgagtatgagatttcttatcaattatgagtgaaatattctatctgaatgcattggaaggcatttacagtatttgctttcaacagttactgagtatgacattttagcatgaaatatatcaaacacatcatttgaaggacatatgtaatcttgactatggttatggtttttttgtatgtattccttgttttcatattgatagcatctaattcttttgacaatcttaatatgtaggttcatttaaattttaagacagttcagtgcatatatagtagaagccttaagaaaaaagaaaatgagcaagcaaatatttgaagaaatgtataaaaccatagatttctttcagaaaaaaaaaacaggcataggaacagttttctcttcatatattatgattatgaataataggaaagttgtattaattcagtatttgtcattatgcagtattttaatacctacataagtctattccattattatattttgcgcttggcatatttattcctttatgcttttaatcactaacatattttacttaagagtataaaactatgctaaataaattgtattgtatatggaatatgcttgccattatgaagaacagctgggtataccattatttcaagtaataaatctgaattctattagtttaaaaattgtaaaattcaagttaaatgacgtgtatgatatataagctgaacacattttctatagcccttaatttagttgtgttaatttttcaaggtgatgtatcaacagctttttttattttgcatttgttttttcaatgtgtttacattgtatgaattgagctttttgcccacagattcttgatttgtagttgtttggcaggatttttctttgtgatataatcacttct

SEQ ID NO: 147825 - DNA, 4622 bp, Homo sapiens
  Payload ID: 9249
  Gene Symbol: LEPROT
  Gene Name: leptin receptor overlapping transcript
  Uniprot ID: O15243
  ENST ID: ENST00000371065
  CDS Start-End: 139-534
gttctgcaccggcgggggcggggctctgcgtggccggggcgggctcgggatccgcggggcgactcccggtctggcttgggcaggctgcccgggccgtggcaggaagccggaagcagccgcggccccagttcgggagacatggcgggcgttaaagctctcgtggcattatccttcagtggggctattggactgacttttcttatgctgggatgtgccttagaggattatggcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtgatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacgtgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaatttttttgtgatgttgccttgcctgaaaagataacaaaaatgagagaatttcttgatgttttaaaatgggcagttttgagcaataatctgtcctaacagaacagtagcaataagttttaggataccatcttgaatgtctagttggtgtgcaatagcttttctttctaagatggcaataatgattcatttctactacattttgcaaaagtgtttttgttgcttatacacattttcaataaccaaggtagccttcatatgtagccttaaagcattacctcttgattgtatctttagattgatataaagtacttgcatatagagtatttgaagtgatagattattagatttgctctatgtctgaaaagagagctattctgcagtgcctaaatatcatttaaacagtaaatattaataggaaatattgctatatctgaatatataatacaaaagtttgatcatggtgacacaaatgttggacatttttttccttataaaaggctctttttttatatattgtacaatatatttggagattcagagcatagtgactatagtcgaaaactgagattgcacttccaaaattggccacaagtaaataatcttatgaagggattctttatcatgtttcaaacaagtgggttacaagcagactttgagacacttttccacagaaacaatactatgaattggtgattgagttcccaggccaagcctccctcaacaggttcaactctaatatacctaacctgtgatactgaaggtgcctgcctgagttttgggtctctgagacagggtagtgtgagtagtttggaggaaggacagtgcaactttccaccccttttcctaagaacaaggtctttctccttttaatttttccactcattttcacctcctaatgcccttgagatccaggtacactcctgggagttttgttcacctctcccaactgagaaccttcccactgggctccatcctccctcctgaggttcttcatattccagagtcacccacccttctcctcccattagtcagttctctaagtacagctgatgtcatgtggtgctgagaagaaagcagatcacacttcatcacagaaagaatgccttgtgattatcttctccacatctgaaattccttttgacacctgcattgggccgactgccattcccatgactgctgcacctgcgtttttagagaatgcctcataacccactgattctcattcacagagaatgggagaacggaatgaagaaagattccagcagcttatagaaggatagcaatattttgggacagggaaaatcctgtcatacctcatctcttcctcaggaggagttctgagctggtcctgcttttcatagttgtttcttttcttccacttaagaactcatagatttttcttactgtcctaaggaagtccttacctctgaggtatctcctcaatgaatactgttttcaaggctgaaatagttcattatgttaataaccttctttatgttctcagggaaatgcttaggtggtgtcacaaaatgtgccttttcttttctttttttttttttttttttgaggcagagtctcgctctgttgcccaggctggagtgcagtggtgcgatcttggctcactgcaagctccgcctcccgggttcacgccattctcctgcctcagcctcccaaggagctgggactacaggctcccgccaccacgcctggctaatttttttgtatttttagtaaagacgggtttcatcgtgttagccaggatggtctcgatctcctgacctcatgatccgcccgcctctgcctcccaaagtgctgggattacaggcctgagccactgtgcccagccaaaatgtgcctttgcaaagtttgcgaaatcagattttgtatcccaatagaaccaaaatatttatgaggatgctagcattttccaagcatagtaattagttcacaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaaccccaaatgtgatgtgagaggacgattactttgtaaataaaacttgttattgacattttaa

SEQ ID NO: 147826 - DNA, 4625 bp, Homo sapiens
  Payload ID: 9249
  Gene Symbol: LEPROT
  Gene Name: leptin receptor overlapping transcript
  ENST ID: ENST00000613538
  CDS Start-End: 115-537
tcgggagacatggcgggcgttaaagagaagaaaccagtgtgtgtgtagtatgtgttttttgcatggggcagttggtaaaaacaccgcgtcccttatctgtatggcttcagagcaatgcgagacggaaaaggttttttgcaaggcttcctgtattttgctctcgtggcattatccttcagtggggctattggactgacttttcttatgctgggatgtgccttagaggattatggcgtttactggcccttattcgtcctgattttccacgccatctcccccatcccccatttcattgccaaaagagtcacctatgactcagatgcaaccagtagtgcctgtcgggaactggcatatttcttcactactggaattgttgtttctgcctttggatttcctgttattcttgctcgtgtggctgtgatcaaatggggagcctgcggccttgtgttggcaggcaatgcagtcattttccttacaattcaagggtttttccttatatttggaagaggagatgattttagctgggagcagtggtagcactttattctgattacagtgcattgaatttcttagaactcatactatctgtatacatgtgcacatgcggcattttactatgaaatttaatatgctgggttttttaatacctttatatatcatgttcactttaagaaagacttcataagtaggagatgagttttattctcagcaaatagacctgtcaaatttagattatgttactcaaattatgttacttgtttggctgttcatgtagtcacggtgctctcagaaaatatattaacgcagtcttgtaggcagctgccaccttatgcagtgcatcgaaaccttttgcttggggatgtgcttggagaggcagataacgctgaagcaggcctctcatgacccaggaaggccggggtggatccctctttgtgttgtagtccatgctattaaaagtgtggcccacagaccaagagcctcaacatttcctagagccttattagaaatgcagaatctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgtttaaaaaaaaaaaaaaagtctcacctgctttcatgctgaggacaagttcagatgttcaagcctataatatttaggcagttcctcaaatttatgaaaagtgttctcagaattgggagacagtcaaagggtacaaagcctcagttaggaggaataagtgtgatttttttttaaagatcacttgcacagcatgctaaatataggaataattgaatgtatatttcaatattgctaagagagtaaatttctaatgttctcataaaaaagttaaatatttgagatcatatgttaattagtgtaatcattccaccttatattcaaaaatcataaaaccgtattgtaccctataaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagaacagataggtaactcttttacatttcctttatgatctggcacttctccccagctccttccctctgccccccacccctactcctcaacagttctggtttgccctgacttctctacggctctggcttcttcccgaagagatataggagccatgtaagcacgcagtgggtgaactgcttaatttcactacgtgttgatgtacttgtcttccgtcctgtaggtcttttctatataactttatgccacccttaaatgaatcattgggtatacctgtcatgttggatcctgtaatcacagttttccctgctcacctttttgtctaagatctattgagaaagggaaatatgggaaggagaaccatttgatcagaatacaaccaatagtctttaagcattgttaaagtatgaaactgaaatacattcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagtttaactttaaaatttttttgtgatgttgccttgcctgaaaagataacaaaaatgagagaatttcttgatgttttaaaatgggcagttttgagcaataatctgtcctaacagaacagtagcaataagttttaggataccatcttgaatgtctagttggtgtgcaatagcttttctttctaagatggcaataatgattcatttctactacattttgcaaaagtgtttttgttgcttatacacattttcaataaccaaggtagccttcatatgtagccttaaagcattacctcttgattgtatctttagattgatataaagtacttgcatatagagtatttgaagtgatagattattagatttgctctatgtctgaaaagagagctattctgcagtgcctaaatatcatttaaacagtaaatattaataggaaatattgctatatctgaatatataatacaaaagtttgatcatggtgacacaaatgttggacatttttttccttataaaaggctctttttttatatattgtacaatatatttggagattcagagcatagtgactatagtcgaaaactgagattgcacttccaaaattggccacaagtaaataatcttatgaagggattctttatcatgtttcaaacaagtgggttacaagcagactttgagacacttttccacagaaacaatactatgaattggtgattgagttcccaggccaagcctccctcaacaggttcaactctaatatacctaacctgtgatactgaaggtgcctgcctgagttttgggtctctgagacagggtagtgtgagtagtttggaggaaggacagtgcaactttccaccccttttcctaagaacaaggtctttctccttttaatttttccactcattttcacctcctaatgcccttgagatccaggtacactcctgggagttttgttcacctctcccaactgagaaccttcccactgggctccatcctccctcctgaggttcttcatattccagagtcacccacccttctcctcccattagtcagttctctaagtacagctgatgtcatgtggtgctgagaagaaagcagatcacacttcatcacagaaagaatgccttgtgattatcttctccacatctgaaattccttttgacacctgcattgggccgactgccattcccatgactgctgcacctgcgtttttagagaatgcctcataacccactgattctcattcacagagaatgggagaacggaatgaagaaagattccagcagcttatagaaggatagcaatattttgggacagggaaaatcctgtcatacctcatctcttcctcaggaggagttctgagctggtcctgcttttcatagttgtttcttttcttccacttaagaactcatagatttttcttactgtcctaaggaagtccttacctctgaggtatctcctcaatgaatactgttttcaaggctgaaatagttcattatgttaataaccttctttatgttctcagggaaatgcttaggtggtgtcacaaaatgtgccttttcttttctttttttttttttttttttgaggcagagtctcgctctgttgcccaggctggagtgcagtggtgcgatcttggctcactgcaagctccgcctcccgggttcacgccattctcctgcctcagcctcccaaggagctgggactacaggctcccgccaccacgcctggctaatttttttgtatttttagtaaagacgggtttcatcgtgttagccaggatggtctcgatctcctgacctcatgatccgcccgcctctgcctcccaaagtgctgggattacaggcctgagccactgtgcccagccaaaatgtgcctttgcaaagtttgcgaaatcagattttgtatcccaatagaaccaaaatatttatgaggatgctagcattttccaagcatagtaattagttcacaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaaccccaaatgtgatgtgagaggacgattactttgtaaataaaacttgttattgacattttaa

SEQ ID NO: 147827 - DNA, 3173 bp, Homo sapiens
  Payload ID: 9250
  Gene Symbol: LEPROTL1
  Gene Name: leptin receptor overlapping transcript-like 1
  Uniprot ID: O95214
  ENST ID: ENST00000321250
  CDS Start-End: 116-511
gctgcgtcgcgcacttccgggtgttgtctggccgccgtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccctgttaaaatggacatacatggaaccactactgatgagggacagttgtatgtttgcatcatatatgccagaaaaccttcctctgcttcctccttttgacttatttggtatgttgtatatattacataaaataacttttcaaatatagtttaataacacttagaagtgtttacttacctggaaaataattgctatgccgtacattcagagtgccccctcccctgcaaggccttgccatgattaacaagtaacttgttagtcttacagataattcatgcattaacagtttaagatttagaccatggtaatagtagttcttattctctaaggttatatcatatgtaatttaaaagtatttttaagacaagtttcctgtatacctctgaactgttttgattttgagttcatcatgatagatctgctgtttccttataaaaggcatttgttgtgtgagttaatgcaaagtagccaagtccagctatatagcagcttcagaaacatacctgaccaaaaaattcccagtaaccaggcatgatcaatttatagtggtcgtttacatctaataattatcaggacttttttcaggagtgggttataaaaacattcaagttggtctgacagtattttgttaaggatatttgtttgtatgtttattcagtatacttacataaaaattatttcgccatcagccaaaactcagtaatcatgacagctgtctgttgttttatgaagtttatttctcaagaaaatgggaataaatttgggatttgttcagcttttttactaaagatgcctaaagccacaggttttattgcctaacttaagccatgacttttagatatgagatgacgggaagcaggacgaaatatcggcgtgtggctggagccttcccactggaggctgaaagtggcttgtggtattataatgttcagatttcaagaggaaggtgcaggtacacatgagttagagagctggtgagacagttgggaactctttgtgcttgtgatctactggacttttttttgcaggaagtgcattctctggtccttccctattttctgttctggatgtcagtgcagtgcactgctactgttttatccacttggccacagactttttctaacagctgcgtattatttctatatactaactgcattggcagcattgtgtctttgaccttgtatactagcttgacatagtgctgtctctgatttctaggctagttacttgagatatgaattttccatagaatatgcactgatacaatattaccattcttctatggaaagaaaacttttgatgatgaaacaataaagattttaaatatctattttagtttgtgggtgtttttgaaatgaaaatatatggcacactttcattctgaagtgcattaacattctaataaggtgatgtaaagcaagatgacattggtgtaatgttagagttgcagaagtttccattccaaaataaaatggaaaccatagttacagatattacaatgcagccctgtaattttgagctgtagtaaaaggattggtaatctgggaagtagaatttttacaaaatcttttacaaaaatagtcataaaaggttttgttgacatttaagactactactgatctaaaggcaaggtcctacttcttaaattttcagaacatttttatgacttcttattatgtatttattaccactcattattatagcatgttactttttgcaaacattttaaacaaaaaatatttctgtttggtacactgtgaagagagaaaagtactgttctgtattttc

SEQ ID NO: 147828 - DNA, 908 bp, Homo sapiens
  Payload ID: 9250
  Gene Symbol: LEPROTL1
  Gene Name: leptin receptor overlapping transcript-like 1
  ENST ID: ENST00000442880
  CDS Start-End: 89-523
ctggccgccgtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgggtccagatgtctgcatcggggacatatccctcctctccagggctctgaccaagctcaggcccaaagcccgctgcgtggaggagggagtcgtccaggatccagtgggagtagtagatggggcgcctacccttcttcagcaagatgggaacagctgagtctgaaggaagagaaacactgacacagcagctgcctctcccagcagccgccatgagaagattgttacctgcaagcagagtgtccactcaacccgtgctgaggctggcagacagtgctgagtcacttctgggcaggcctgctctgtgggctctaggattcctgctttgccctccctctcaggcacaatgacaactactgctcagtgccagacactgcaccatgtaggcaacacgtggcagtgatgattagtcacaaaatcacatttatattcattctaatgaaactgccattgcaaaattataactgagacagtgaaagaagtctgacctaaccaactccatcttgcttctaacctccaagctgtccttgttcattcccgggact

SEQ ID NO: 147829 - DNA, 847 bp, Homo sapiens
  Payload ID: 9250
  Gene Symbol: LEPROTL1
  Gene Name: leptin receptor overlapping transcript-like 1
  ENST ID: ENST00000518192
  CDS Start-End: 156-620
ggggaagcgacccccgccccggccctgcgcttggcccggaggtgggcgcggcgccctcgggcaacggacggttgcgaccccggcttcgccccgcagcccccactttctgccgatttcggcagcctctctcccacccatcgccccccggacaaaatatgaagtggttggcggtcagtgaggagtcccgtcgcgacttggacggccacacacgttttgcaggagtttgcatccgagagagagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatcta

SEQ ID NO: 147830 - DNA, 1389 bp, Homo sapiens
  Payload ID: 9250
  Gene Symbol: LEPROTL1
  Gene Name: leptin receptor overlapping transcript-like 1
  Uniprot ID: O95214
  ENST ID: ENST00000523116
  CDS Start-End: 34-543
tcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgatggggcgcctacccttcttcagcaagatgggaacagctgagtctgaaggaagagaaacactgacacagcagctgcctctcccagcagccgccatgagaagattgttacctgcaagcagagtgtccactcaacccgtgctgaggctggcagacagtgctgagtcacttctgggcaggcctgctctgtgggctctaggattcctgctttgccctccctctcaggcacaatgacaactactgctcagtgccagacactgcaccatgtaggcaacacgtggcagtgatgattagtcacaaaatcacatttatattcattctaatgaaactgccattgcaaaattataactgagacagtgaaagaagtctgacctaaccaactccatcttgcttctaacctccaagctgtccttgttcattcccgggactcattttgggaggaacttagttaatagcttacagtttaaaacaaagacaatcacagacctttcccaaaacaaacccccttcttgcctggaaactagactgcctttgtaggattaacaaattagccgaaagattagaaattatggtttaggagtcatgcagctggagatgacaagattctgacactcctccaattgctcctggggataacattactattctaaggcctaacatcagtgcttgagatgttttgtagaccctgcccttgatggatcagctggtactacccagaccgataaactggctcgtcttatcttgtggcccccacccaggagctgactcaatgcaagaagactgttctgactccctatgatttcatctccaacccaaccaagcggcactgtcaactcactggcctccccctacccaccaaattatccttaaaaactcagatccccaaatgctcagggaaactgattatgattaccccaaagcttggagtaataataaaactggcctgtctcccgcacagccagctctctgtgaattactctttctttactgcaattcccctgtttgtctaggcagtggagaaggtgaacccactgggcggttacactaacattcacaacaatcttgcaacacagtattgtt

SEQ ID NO: 147831 - DNA, 575 bp, Homo sapiens
  Payload ID: 9250
  Gene Symbol: LEPROTL1
  Gene Name: leptin receptor overlapping transcript-like 1
  ENST ID: ENST00000519466
  CDS Start-End: 1-410
ttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgatggagtcttgctctgtcgcccagcctggagtgcagtggcgtgatctcacctcactgcaagctctgcctcccgggttcacgccattctcctgcctcagcctcccgagtagctgggactacaggtgcccgccaccacgcccagctgatattttttgtgtttttagtggagacgaggtttcaccgtgttagccagaatggtctcgacctcctgacctcgtgatccgtccgcctcggcctcccaaagtgctgggattacaggcatgagccaccgcacccgtctggcttgctaatacttaactgtcagagttgagcatatcaactcccccagtgctgaacaacccaggcctatcctgt

SEQ ID NO: 147832 - DNA, 559 bp, Homo sapiens
  Payload ID: 9250
  Gene Symbol: LEPROTL1
  Gene Name: leptin receptor overlapping transcript-like 1
  ENST ID: ENST00000520739
  CDS Start-End: 27-347
gtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgtgtgaagattgctcctggagcagttgtatgtgtagaaagtgaaatcagaggagatgtaactatcggacctcggacagtgatccaccctaaagcaagaattattgcggaagccgggccaatagtgattggcgaagggaacctaatagaagaacaggcccttatcataaatgcttacccagataatatcactcctgacactgaagatccagaaccaaaacctatgatcattggcaccaataatgtgtttgaagttg

SEQ ID NO: 147833 - DNA, 580 bp, Homo sapiens
  Payload ID: 9250
  Gene Symbol: LEPROTL1
  Gene Name: leptin receptor overlapping transcript-like 1
  ENST ID: ENST00000520682
  CDS Start-End: 94-580
gttgtctggccgccgtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgcaaaagcagaatacagtacaccatgggaaagacactgttgtacgaattacagagcaaccagagagaggagagactcctgacctccacagccagcatgatgtaggcaatgatcaactgggtgtgggcccaggtgagggttctatagaacagcctcatcggccaggatctgataaactcattggcaaaggagtgaatcaggtagtcagct

SEQ ID NO: 147834 - DNA, 589 bp, Homo sapiens
  Payload ID: 9250
  Gene Symbol: LEPROTL1
  Gene Name: leptin receptor overlapping transcript-like 1
  ENST ID: ENST00000518001
  CDS Start-End: 211-423
acttccgggtgttgtctggccgccgtagcgcgtcttgggtctcccggctgccgctgctgccgccgccgcctcgggtcgtggagccaggagcgacgtcaccgccatggcaggcatcaaagcaaatactggcccctctttgttctatttttttacatcctttcacctattccatactgcatagcaagaagattagtggatgatacagatgctatgagtaacgcttgtaaggaacttgccatctttcttacaacgggcattgtcgtgtcagcttttggactccctattgtatttgccagagcacatctgattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagact

SEQ ID NO: 147835 - DNA, 4260 bp, Homo sapiens
  Payload ID: 9251
  Gene Symbol: LLGL1
  Gene Name: lethal giant larvae homolog 1 (Drosophila)
  Uniprot ID: Q15334
  ENST ID: ENST00000316843
  CDS Start-End: 97-3291
cgcctggcgccccgcccgcgccttaggacccgcggggccgcgcggcgcatcctgcgggcggcggcggcgggcgaggcgcctgcagccgggcgcaagatgatgaagtttcggttccggcggcagggcgccgacccgcagcgcgagaagctcaagcaggagcttttcgccttcaacaagactgtggagcatggcttccccaatcagcccagcgccctggccttcgacccggaacttcgcatcatggccatcggcaccaggtctggggctgtcaagatctatggtgcacctggcgtggagttcacaggcctgcaccgggatgcagccactgtcacacagatgcacttcttgaccggccagggccgcctcctgtccctgcttgatgacagcagtctgcatctctgggagattgtccaccataatggctgtgcccacctggaagaagcactcagtttccagctgcccagccggcccggctttgatggtgccagtgctccgctcagccttacccgagtcacagtggtcctgctggtggctgccagcgacatagcagccctgggcactgagggcagcagtgtcttcttcctggatgttaccaccctgaccctgctcgaggggcagacgcttgccccaggcgaggttctgcgcagcgtgccagacgactaccgctgtgggaaggcactgggccccgtggagtcactccagggacacctgcgggaccccacaaagattctcattggctacagccggggcctgctggtcatctggaaccaggcctcgcagtgtgtggaccacatcttcctggggaaccagcagctggagagcctatgctgggggcgtgatagcagcactgtggtcagctcacacagcgatggcagctatgctgtctggtctgtggatgccggcagcttcccaacgctgcagcccacggtagccaccacaccttacggcccctttccctgcaaggccattaacaagattctgtggcggaactgtgaatctgggggccactttatcatcttcagcggtggcatgccccgtgccagctatggtgaccgccactgtgtaagtgtgcttcgagccgagacattggtgacgctggacttcacttcccgcatcatcgacttcttcacagtgcacagcacacggcccgaggatgaatttgatgacccccaggccctggctgtgctgctggaagaggagctggtggtgctggacctgcagactcctggctggccagctgtgcctgccccatacctggccccgctgcactcctctgcaatcacttgctcggcccacgtggccagtgtccccgccaagctgtgggcccgcattgtgagcgctggcgagcagcagagcccccagcctgtctccagtgccttgagctggcccatcactgggggccgaaacctggcccaggagccgtcacagcgagggctgctgctgacgggccatgaggacggcaccgtgaggttctgggatgcctcgggtgtggcgctgcggccgctctataagctgagcacagctggcctcttccagacagactgtgagcacgctgacagcctggcccaggctgccgaggacgactggccacccttccgcaaggtgggctgcttcgatccctacagtgacgatccccggcttggcgtgcagaaggttgctctctgcaagtatacagcccagatggtggtggctggcactgcaggccaggtgctggtactggagcttagtgatgtgccggtggagcaggcggtcagcgtggccatcatagacctcctccaggaccgcgagggcttcacatggaagggccacgagcggctgagcccacgcacggggccgctgccctggcctgctggcttccagccccgtgtcctggtgcagtgcctgccgccagctgctgtaaccgctgtcacactccacaccgagtggagcctcgtggcttttggcaccagtcatggctttggcctcttcgactaccagcgcaagagccctgtgctggccaggtgcactcttcaccccaatgactccctggccatggagggtccgctctcccgggtgaagtctctcaagaagtcactgcgccagtctttccggcgcattcgcaagagtcgtgtctctggcaagaagcgggctgctaatgccagcagcaagttgcaggaagccaatgcacagctggctgagcaggcctgcccccacgacgtggagatgacgcccgtgcagcgccgcattgagccccgctctgccgatgactccttgtcgggtgtcgtgcgttgcctatactttgccgacacattccttcgagatggggcccaccacgggcccaccatgtgggctggcaccaactcaggctctgtgttcgcctatgcactggaggtgccggcagcagcagtgggtggtgagaagcggcctgagcaagcggtggaggccgtgctgggcaaggaggtgcagctgatgcaccgggcgcctgtggtggccattgccgtgttggacgggcgtggccgcccactgcccgagccctacgaggcctcacgggacctggcgcaggcacctgacatgcagggtggtcacgctgtgctcatcgcatctgaggagcagttcaaggtgttcacactgcccaaggtgagcgcgaagaccaagttcaagctgacggcccatgagggctgtcgtgtgcgcaaggtggcactggccacgtttgccagtgtggcctgcgaggactatgctgagacctgcctggcctgcctcaccaacctgggtgacgtccacgtcttctcggtgcctggcctgcggccccaggtgcactattcctgcatccggaaggaggacatcagcggcatcgcttcgtgcgtctttacgcgccatggccagggcttttacctgatatccccatcagaatttgaacgcttctccctaagtgcccggaacatcacagagccgctctgctctctggacattaactggccccgcgatgccacccaggccagttacaggatccgagagtcacccaagctgagccaggctaacgggaccccaagcatcctgctggccccacagagccttgatggaagccctgatccagcccacagcatgggacctgacaccccggagccacccgaggctgcactctcacccatgtccatcgactcagccaccagtgctgacaccacgctggacacgacaggggacgtcacagtggaagatgtgaaggatttcctgggctcctctgaggagtcagagaagaacctgaggaacctggcagaagacgaggcccacgcctgtgccatcctgatcaaatgaggaaggccagaactatcccgacctccacctgccctgctcggagctggagtgctggatccctggcacctgcctggccccttaacatagaaccacgcctgctaacctgtaggctccactgggacctgctgtcctgtcccgcctgaccctgggccctggagcagcaccagccccagggtgtgggcctgggacctgggccagaactgagccctcctgcaggcatttggctgccctgggggcccactgcctagggaagaggacaggtggggcccagcacctgtgccacctccccccctccacacaccatccttccccctcactttgcagagtatttttccttttttttttttttcttaaagacggagtcttgctctgtcgcccaggctggagtgcagtggccccatctctgctcactgcaagccccgccttctgggttcccgccattcttctgcctcagcctcccaagtagctgggactacaggcgcccaccaccacgcccagctaattttttctgtatttttagtagagatggggtttcaccatgttagccaggatggtctcgatctcctgacctcgtgatccacccacctcagcctcccaaagtgctgggattacaggcgtgagccaccatgcccagccctgcaaagagtatttttctagcgcctgggctggacagttgtttctaaaactaaactattttggtacctgcttctgggccagtccccagcctgtcatgagtgtgtgtgtgcgggcatggatgtgactgggagctctgctgggcacccacatctggggcctagtcaggtgtgtgtgtccggcggggggggggggcaggggggggggtcaagatgagtttccctgtagattgtaccttggggtttttttctgtcgttttgttaaaattagcgccattttaatattaaaaatactgatttttaatattgaaaataaaagcatttaatatctcttaaa

SEQ ID NO: 147836 - DNA, 3187 bp, Homo sapiens
  Payload ID: 9251
  Gene Symbol: LLGL1
  Gene Name: lethal giant larvae homolog 1 (Drosophila)
  ENST ID: ENST00000621229
  CDS Start-End: 7-3177
cgcaagatgatgaagtttcggttccggcggcagggcgccgacccgcagcgcgagaagctcaagcaggagcttttcgccttcaacaagactgtggagcatggcttccccaatcagcccagcgccctggccttcgacccggaacttcgcatcatggccatcggcaccaggtctggggctgtcaagatctatggtgcacctggcgtggagttcacaggcctgcaccgggatgcagccactgtcacacagatgcacttcttgaccggccagggccgcctcctgtccctgcttgatgacagcagtctgcatctctgggagattgtccaccataatggctgtgcccacctggaagaagcactcagtttccagctgcccagccggcccggctttgatggtgccagtgctccgctcagccttacccgagtcacagtggtcctgctggtggctgccagcgacatagcagccctgggcactgagggcagcagtgtcttcttcctggatgttaccaccctgaccctgctcgaggggcagacgcttgccccaggcgaggttctgcgcagcgtgccagacgactaccgctgtgggaaggcactgggccccgtggagtcactccagggacacctgcgggaccccacaaagattctcattggctacagccggggcctgctggtcatctggaaccaggcctcgcagtgtgtggaccacatcttcctggggaaccagcagctggagagcctatgctgggggcgtgatagcagcactgtggtcagctcacacagcgatggcagctatgctgtctggtctgtggatgccggcagcttcccaacgctgcagcccacggtagccaccacaccttacggcccctttccctgcaaggccattaacaagattctgtggcggaactgtgaatctgggggccactttatcatcttcagcggtggcatgccccgtgccagctatggtgaccgccactgtgtaagtgtgcttcgagccgagacattggtgacgctggacttcacttcccgcatcatcgacttcttcacagtgcacagcacacggcccgaggatgaatttgatgacccccaggccctggctgtgctgctggaagaggagctggtggtgctggacctgcagactcctggctggccagctgtgcctgccccatacctggccccgctgcactcctctgcaatcacttgctcggcccacgtggccagtgtccccgccaagctgtgggcccgcattgtgagcgctggcgagcagcagagcccccagcctgtctccagtgccttgagctggcccatcactgggggccgaaacctggcccaggagccgtcacagcgagggctgctgctgacgggccatgaggacggcaccgtgaggttctgggatgcctcgggtgtggcgctgcggccgctctataagctgagcacagctggcctcttccagacagactgtgagcacgctgacagcctggcccaggctgccgaggacgactggccacccttccgcaaggtgggctgcttcgatccctacagtgacgatccccggcttggcgtgcagaaggttgctctctgcaagtatacagcccagatggtggtggctggcactgcaggccaggtgctggtactggagcttagtgatgtgccggtggagcaggcggtcagcgtggccatcatagacctcctccaggaccgcgagggcttcacatggaagggccacgagcggctgagcccacgcacggggccgctgccctggcctgctggcttccagccccgtgtcctggtgcagtgcctgccgccagctgctgtaaccgctgtcacactccacaccgagtggagcctcgtggcttttggcaccagtcatggctttggcctactggaccctgtcttccccaggtgcactcttcaccccaatgactccctggccatggagggtccgctctcccgggtgaagtctctcaagaagtcactgcgccagtctttccggcgcattcgcaagagtcgtgtctctggcaagaagcgggctgctaatgccagcagcaagttgcaggaagccaatgcacagctggctgagcaggcctgcccccacgacgtggagatgacgcccgtgcagcgccgcattgagccccgctctgccgatgactccttgtcgggtgtcgtgcgttgcctatactttgccgacacattccttcgagatggggcccaccacgggcccaccatgtgggctggcaccaactcaggctctgtgttcgcctatgcactggaggtgccggcagcagcagtgggtggtgagaagcggcctgagcaagcggtggaggccgtgctgggcaaggaggtgcagctgatgcaccgggcgcctgtggtggccattgccgtgttggacgggcgtggccgcccactgcccgagccctacgaggcctcacgggacctggcgcaggcacctgacatgcagggtggtcacgctgtgctcatcgcatctgaggagcagttcaaggtgttcacactgcccaaggtgagcgcgaagaccaagttcaagctgacggcccatgagggctgtcgtgtgcgcaaggtggcactggccacgtttgccagtgtggcctgcgaggactatgctgagacctgcctggcctgcctcaccaacctgggtgacgtccacgtcttctcggtgcctggcctgcggccccaggtgcactattcctgcatccggaaggaggacatcagcggcatcgcttcgtgcgtctttacgcgccatggccagggcttttacctgatatccccatcagaatttgaacgcttctccctaagtgcccggaacatcacagagccgctctgctctctggacattaactggccccgcgatgccacccaggccagttacaggatccgagagtcacccaagctgagccaggctaacgggaccccaagcatcctgctggccccacagagccttgatggaagccctgatccagcccacagcatgggacctgacaccccggagccacccgaggctgcactctcacccatgtccatcgactcagccaccagtgctgacaccacgctggacacgacaggggacgtcacagtggaagatgtgaaggatttcctgggctcctctgaggagtcagagaagaacctgaggaacctggcagaagacgaggcccacgcctgtgccatctgatcaaatgagg

SEQ ID NO: 147837 - DNA, 3480 bp, Homo sapiens
  Payload ID: 9252
  Gene Symbol: LLGL2
  Gene Name: lethal giant larvae homolog 2 (Drosophila)
  Uniprot ID: Q6P1M3
  ENST ID: ENST00000167462
  CDS Start-End: 131-3178
cgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccacctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagcggcaactggcgttcacatcgagccgccgtggggtgcagcctcagcaatggcggagcagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctcttg

SEQ ID NO: 147838 - DNA, 1374 bp, Homo sapiens
  Payload ID: 9252
  Gene Symbol: LLGL2
  Gene Name: lethal giant larvae homolog 2 (Drosophila)
  Uniprot ID: Q6P1M3
  ENST ID: ENST00000375227
  CDS Start-End: 125-1195
gcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagtaggagagcttcgggagtgggtgcccagggttaggtgtgggaggcatggggcaggaccatcagtaaagacagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagcca

SEQ ID NO: 147839 - DNA, 3509 bp, Homo sapiens
  Payload ID: 9252
  Gene Symbol: LLGL2
  Gene Name: lethal giant larvae homolog 2 (Drosophila)
  Uniprot ID: Q6P1M3
  ENST ID: ENST00000392550
  CDS Start-End: 118-3180
gtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccacctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagtcctgaaggaaatccagagcacactggagggagaccgcgggagcggcaactggcgttcacatcgagccgccgtggggtgcagcctcagcaatggcggagcagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcctctgggtgaaaaagtttttaataaacacctattacctctt

SEQ ID NO: 147840 - DNA, 204 bp, Homo sapiens
  Payload ID: 9252
  Gene Symbol: LLGL2
  Gene Name: lethal giant larvae homolog 2 (Drosophila)
  ENST ID: ENST00000580925
  CDS Start-End: 86-204
agcttttcctacccccattataaggccacaggtggtgacagccttcagccctgaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggcta

SEQ ID NO: 147841 - DNA, 409 bp, Homo sapiens
  Payload ID: 9252
  Gene Symbol: LLGL2
  Gene Name: lethal giant larvae homolog 2 (Drosophila)
  ENST ID: ENST00000583514
  CDS Start-End: 1-189
ctggtggattcagcagaaaccaagaaccaccgccctggtaacggtgcgggccccaagaaggccccgagccgagccaggaactcagggactcagagtgatggcgaggccctgggccctgggcttccacatcctgacctcagtaaggagagagagagccaggccgaggagggcccaggcggggcgccctgacccggcctctaccttccagagaagcagcccggcctggtgatggagcgcgctctgctcagtgatgagagagtcctgaaggaaatccagagcacactggagggagaccgcgggagcggcaactggcgttcacatcgagccgccgtggggtgcagcctcagcaatggcggagcagagtgagtggctgagcgtccaggctgcgcgatgagcacacactactact

SEQ ID NO: 147842 - DNA, 680 bp, Homo sapiens
  Payload ID: 9252
  Gene Symbol: LLGL2
  Gene Name: lethal giant larvae homolog 2 (Drosophila)
  ENST ID: ENST00000578719
  CDS Start-End: 1-317
agagggacctgctgctcacagggtgggttctgcccacaggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattcc

SEQ ID NO: 147843 - DNA, 585 bp, Homo sapiens
  Payload ID: 9252
  Gene Symbol: LLGL2
  Gene Name: lethal giant larvae homolog 2 (Drosophila)
  ENST ID: ENST00000581713
  CDS Start-End: 167-585
actgtgaagctggcctggccccggggtggcagcctactggacttggagagagaggccctgctccacctgtttgggccgggcctaatcgatacctgagtgccaggacagacccctgcagctccttctgtttctccaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctc

SEQ ID NO: 147844 - DNA, 2367 bp, Homo sapiens
  Payload ID: 9252
  Gene Symbol: LLGL2
  Gene Name: lethal giant larvae homolog 2 (Drosophila)
  ENST ID: ENST00000578638
  CDS Start-End: 1-259
taccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccactgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagtcctgaaggaaatccagagcacactggagggagaccgcgggagcggcaactggcgttcacatcgagccgccgtggggtgcagcctcagcaatggcggagagtgagtggctgagcgtccaggctgcgcgatgagcacacactactactgatggcctttcgggggtccctgccccaaccggagaggccggtgcacagggccccgccaggggctgggggcatcccggcttccacaatgcagctgctctgggcctcgggagaggagagaccccagtcccctgggctgcccttcccgggcctcgtctgtctgggtcctttggtcaatgttgcacagtttttattgctcccatccctttttgtagtgggctgggttttaagttataaatgttaactgcctctgggtgaaaaagtttttaataaaca

SEQ ID NO: 147845 - DNA, 483 bp, Homo sapiens
  Payload ID: 9252
  Gene Symbol: LLGL2
  Gene Name: lethal giant larvae homolog 2 (Drosophila)
  ENST ID: ENST00000579392
  CDS Start-End: 174-483
gccgaggcctcgggcgggggctggcccggggttccagataacgagtgaggactcgctgtgtgcactcggatacagcagtgaataaaaggacaaaaggtcttgaatgggaaaaagaaagctgctgcttgtgggggattccacaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaagg

SEQ ID NO: 147846 - DNA, 3192 bp, Homo sapiens
  Payload ID: 9252
  Gene Symbol: LLGL2
  Gene Name: lethal giant larvae homolog 2 (Drosophila)
  ENST ID: ENST00000577200
  CDS Start-End: 105-3164
ggctcactgcaacctctgcctcccgggttcaagcaattctcctgcctcggcctcctgagtagctgggattacaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccacctttgacgacccctatgccctggtggtgctggctgaggaggagctggtggtgattgacctgcagacagcaggctggccaccggtccagctgccctacctggcttctctgcactgttccgccatcacctgctctcaccacgtctccaacatcccgctgaagctgtgggagcggatcattgccgccggcagccggcagaacgcacacttctccaccatggagtggccaattgatggtggcaccagcctgaccccagccccaccccagagggacctgctgctcacagggcacgaggacggcacggtgcggttctgggatgcctcgggtgtctgcctgcggctgctctacaaactcagcactgtgcgcgtgttcctcaccgacacggaccccaacgagaacttcagtgcccagggcgaggacgagtggcccccactccgcaaggtgggctcctttgacccctacagtgatgacccccggctgggcatccagaagatcttcctctgcaagtacagcggctacctggctgtggcaggcacggcagggcaggtgctggtactggaactgaatgacgaggcagcggagcaggctgtggagcaggtggaggccgacctgctgcaggaccaagagggctaccgctggaaggggcacgagcgcctggcagcccgctcagggcccgtgcgctttgagcctggctttcagcccttcgtgttggtgcagtgtcagcccccggctgtggtcacctccttggccctgcactctgagtggcggctcgtggccttcggcaccagccatggctttggcctctttgaccaccagcagcggcggcaggtctttgttaagtgcacactgcaccccagtgaccagctggccttggagggcccactctcccgcgtcaagtccctcaagaagtccttgcgtcagtcattccgccggatgcgtcggagccgggtgtccagccggaagcggcacccggctggccccccaggagaggcacaggaggggagtgccaaggctgagcggccaggcctccagaacatggagctggcgcctgtgcagcgcaagatcgaggctcgctcggcagaggactccttcacaggcttcgtccggaccctgtactttgctgacacctacctgaaggacagctcccggcactgcccctcgctgtgggctggcaccaatgggggcaccatctatgccttctccctgcgtgtgcctcccgccgagcggagaatggatgagcctgtgcgggcagagcaggccaaggagatccagctgatgcaccgggcgccggtggtgggcatcctggtgctcgacggacacagcgtaccccttcccgagcccctcgaagtggcccatgatctgtcgaagagccctgacatgcagggaagccaccagctgctcgtcgtatcagaggagcagttcaaggtgttcacgctgcccaaggtgagtgccaagctgaagttgaagctgacggccctggagggctcaagagtgcggcgggtcagcgtggcccacttcggcagtcgtcgagccgaggactacggggagcaccacctggcagtccttaccaacctgggcgacatccaggtggtctcgctgcccctgctcaagccccaggtgcgctacagctgcatccgccgggaggacgtcagtggcatcgcctcctgcgtcttcaccaaatatggccaaggcttctacctgatctcaccctcggagtttgagcgcttctctctctccaccaagtggctggtggagccccggtgtctggtggattcagcagaaaccaagaaccaccgccctggtaacggtgcgggccccaagaaggccccgagccgagccaggaactcagggactcagagtgatggcgaggagaagcagcccggcctggtgatggagcgcgctctgctcagtgatgagagagtcctgaaggaaatccagagcacactggagggagaccgcgggagcggcaactggcgttcacatcgagccgccgtggggtgcagcctcagcaatggcggagagtgagtggctgagcgtccaggctgcgcgatga

SEQ ID NO: 147847 - DNA, 784 bp, Homo sapiens
  Payload ID: 9252
  Gene Symbol: LLGL2
  Gene Name: lethal giant larvae homolog 2 (Drosophila)
  ENST ID: ENST00000578536
  CDS Start-End: 469-784
cctgattattctccactagggcccgtgggaaagagaacctttctgagcacagcccatgagcgcacagggaagctggactggggctagccagagagaggggaggggaccggcagagaccccaggcacggtggcatgggccagcaccccctgaccgagtgctctgtgccacccgtgcccacttgagtttctcatggctgtggctggttggagaggctgaggccgagagtccctggacagccttccccgaggtcagaaggaggaagcatctgcccggtgccctggcctggagtcactgcaggcctctcccctgccccgacttgggctctgatctgggaaggatggccttggtgtttctaccttccacaagactttggaggaagaggcttgcgaagtttccctttctgcttagctggagtttcatggtttctcagaaaacaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagg

SEQ ID NO: 147848 - DNA, 566 bp, Homo sapiens
  Payload ID: 9252
  Gene Symbol: LLGL2
  Gene Name: lethal giant larvae homolog 2 (Drosophila)
  ENST ID: ENST00000583658
  CDS Start-End: 99-566
atgaccgtgaagtctctgacctgggtaggtggtggtgccaggccttgggagggggagcccaggccaggagtggcgaagaacagatttgaggaaaagtaatgtattttgatcgttttgatttggacacaatcgcaacaacagtgctctccatttttggagaggcagcttgcccagagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtg

SEQ ID NO: 147849 - DNA, 577 bp, Homo sapiens
  Payload ID: 9252
  Gene Symbol: LLGL2
  Gene Name: lethal giant larvae homolog 2 (Drosophila)
  ENST ID: ENST00000580578
  CDS Start-End: 126-577
ctttccgctcccgcctctcgtcgctccaacctcctccctcgcttgtgctaaaaattccacccgctgttgcagaccctccggccgacacggaggaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtgg

SEQ ID NO: 147850 - DNA, 1393 bp, Homo sapiens
  Payload ID: 9252
  Gene Symbol: LLGL2
  Gene Name: lethal giant larvae homolog 2 (Drosophila)
  Uniprot ID: Q6P1M3
  ENST ID: ENST00000578363
  CDS Start-End: 142-1212
gccgagggacgccgaggcctcgggcgggggctggcccggggttccagatgttggatgtgatccttaaacaaagcaaagatgtctgccgtcgttgaaagttgtttctaaaaggtctccagtgggggctgcagactaagcaaaatgaggcggttcctgaggccagggcatgaccctgtgcgggagaggctcaagcgggacctgttccagtttaacaagacggtggagcatggcttcccgcaccagcccagcgccctcggctacagcccgtccctgcgcatcctggccatcggcacccgttctggagccatcaagctctacggagccccaggcgtggagttcatggggctgcaccaggagaacaacgctgtgacgcagatccacctcctgcccggccagtgccagctggtcaccctgctggatgacaacagcctgcacctttggagcctgaaggtcaagggcggggcatcggagctgcaggaggatgagagcttcacactgcgtggacccccaggggctgcccccagtgccacacagatcaccgtggtcctgccacattcctcctgcgagctgctctacctgggcaccgagagtggcaacgtgtttgtggtgcagctgccagcttttcgtgcgctggaggaccggaccatcagctcggacgcggtgctgcagcggttgccagaggaggcccgccaccggcgtgtgttcgagatggtggaggcactgcaggagcaccctcgagaccccaaccagatcctgatcggctacagccgaggcctcgttgtcatctgggacctacagggcagccgcgtgctctaccacttcctcagcagccagcaactggagaacatctggtggcagcgggacggccgcctgctcgtcagctgtcactctgacggcagctactgccagtggcccgtgtccagcgaagcccagcaaccagagcccctccgcagcctcgtgccttacggtccctttccttgcaaagcgattaccagaatcctctggctgaccactaggcaggggttgcccttcaccatcttccagggtggcatgccacgggccagctacggggaccgccactgcatctcagtgatccacgatggccagcagacggccttcgacttcacctcccgtgtcatcggcttcactgtcctcacagaggcagaccctgcagccagtaggagagcttcgggagtgggtgcccagggttaggtgtgggaggcatggggcaggaccatcagtaaagacagggccaggtgcagtggctcctgcctgtaaccccagtgctgtgggaggccaaggtggtaggatcgcttgaacccaggagttcaagtccagcctggacaacgtagggagacccttgtctctacaaaaaataaaaaaattagccagg

SEQ ID NO: 147851 - DNA, 2112 bp, Homo sapiens
  Payload ID: 9253
  Gene Symbol: LETMD1
  Gene Name: LETM1 domain containing 1
  Uniprot ID: Q6P1Q0
  ENST ID: ENST00000262055
  CDS Start-End: 40-1122
aaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacatgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttgatggaaa

SEQ ID NO: 147852 - DNA, 1566 bp, Homo sapiens
  Payload ID: 9253
  Gene Symbol: LETMD1
  Gene Name: LETM1 domain containing 1
  ENST ID: ENST00000380135
  CDS Start-End: 14-457
tctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggaccatttctgttctgagtggtataggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacatgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaa

SEQ ID NO: 147853 - DNA, 2123 bp, Homo sapiens
  Payload ID: 9253
  Gene Symbol: LETMD1
  Gene Name: LETM1 domain containing 1
  Uniprot ID: Q6P1Q0
  ENST ID: ENST00000418425
  CDS Start-End: 20-1141
cgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacaggtatgggccaggggcagatatccagaagttcatggtgagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacatgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgtt

SEQ ID NO: 147854 - DNA, 618 bp, Homo sapiens
  Payload ID: 9253
  Gene Symbol: LETMD1
  Gene Name: LETM1 domain containing 1
  ENST ID: ENST00000547256
  CDS Start-End: 1-332
tgatgtcttatgtggtaaccaagacaaaagcgattaatgggaaataccatcgtttcttgggtcgtcatttcccccgcttctatgtcctgtacacaatcttcatgaaagaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcgaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggc

SEQ ID NO: 147855 - DNA, 1186 bp, Homo sapiens
  Payload ID: 9253
  Gene Symbol: LETMD1
  Gene Name: LETM1 domain containing 1
  ENST ID: ENST00000551477
  CDS Start-End: 315-1186
aacagtcgaggctccgacgccccgagtccaggcagagggcaagggcggcgctgggaagccctgaggccctaaggaatcgcggagggtcactgggcgcctcaaggacagggtgccctccgcgtcgcaaacccacaccagtggcataagaactcgctccctctgggacaccctgtttccggcgcctttaaacctggaagtactgctgtgtccaatcctggccctccttccgcacttagtctttgagtccttccctctcctggcttgtgctggagccaagcaggctatggctaccaatcagcgctcagaaaagacgcatgcgtcttcgaacgaacgcgacgtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaac

SEQ ID NO: 147856 - DNA, 727 bp, Homo sapiens
  Payload ID: 9253
  Gene Symbol: LETMD1
  Gene Name: LETM1 domain containing 1
  ENST ID: ENST00000553043
  CDS Start-End: 1-295
cttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcgaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaa

SEQ ID NO: 147857 - DNA, 1480 bp, Homo sapiens
  Payload ID: 9253
  Gene Symbol: LETMD1
  Gene Name: LETM1 domain containing 1
  Uniprot ID: Q6P1Q0
  ENST ID: ENST00000550100
  CDS Start-End: 14-481
tctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacatgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaag

SEQ ID NO: 147858 - DNA, 582 bp, Homo sapiens
  Payload ID: 9253
  Gene Symbol: LETMD1
  Gene Name: LETM1 domain containing 1
  ENST ID: ENST00000548251
  CDS Start-End: 31-582
ctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcag

SEQ ID NO: 147859 - DNA, 1665 bp, Homo sapiens
  Payload ID: 9253
  Gene Symbol: LETMD1
  Gene Name: LETM1 domain containing 1
  ENST ID: ENST00000547008
  CDS Start-End: 17-727
ttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacatgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatg

SEQ ID NO: 147860 - DNA, 563 bp, Homo sapiens
  Payload ID: 9253
  Gene Symbol: LETMD1
  Gene Name: LETM1 domain containing 1
  ENST ID: ENST00000549686
  CDS Start-End: 20-151
cgcttctctcgctgtgaagatggcgctctccagggtgtgctgggctcggtcggctgtgtggggctcggcagtcacccctggacattttgtcacccggaggctgcaacttggtcgctctggcctggcttggggggcccctcgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtg

SEQ ID NO: 147861 - DNA, 469 bp, Homo sapiens
  Payload ID: 9253
  Gene Symbol: LETMD1
  Gene Name: LETM1 domain containing 1
  ENST ID: ENST00000550442
  CDS Start-End: 38-469
agacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagaaagccttgagccgggccatgcttctcacatcttacctgcct

SEQ ID NO: 147862 - DNA, 565 bp, Homo sapiens
  Payload ID: 9253
  Gene Symbol: LETMD1
  Gene Name: LETM1 domain containing 1
  ENST ID: ENST00000550814
  CDS Start-End: 92-565
ctcttctctcccgcttctctcgctgtgaagatggcgctctccagggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagttccgccaagacgtcaccaagtgtcttttcctaggtattatttccattccaccttttgccaactacctggtcttcttgctaatcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatatt

SEQ ID NO: 147863 - DNA, 2001 bp, Homo sapiens
  Payload ID: 9253
  Gene Symbol: LETMD1
  Gene Name: LETM1 domain containing 1
  ENST ID: ENST00000547318
  CDS Start-End: 57-473
acggttaactttgacccaaagacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacatgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacc

SEQ ID NO: 147864 - DNA, 521 bp, Homo sapiens
  Payload ID: 9253
  Gene Symbol: LETMD1
  Gene Name: LETM1 domain containing 1
  ENST ID: ENST00000551261
  CDS Start-End: 31-330
ctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggcaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttccca

SEQ ID NO: 147865 - DNA, 552 bp, Homo sapiens
  Payload ID: 9253
  Gene Symbol: LETMD1
  Gene Name: LETM1 domain containing 1
  ENST ID: ENST00000550755
  CDS Start-End: 101-232
aaagacaacctcttctctcccgcttctctcgctgtgaagatggcgctctccagggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggcaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcattt

SEQ ID NO: 147866 - DNA, 818 bp, Homo sapiens
  Payload ID: 9253
  Gene Symbol: LETMD1
  Gene Name: LETM1 domain containing 1
  ENST ID: ENST00000549340
  CDS Start-End: 37-818
gacaacctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtgg

SEQ ID NO: 147867 - DNA, 433 bp, Homo sapiens
  Payload ID: 9253
  Gene Symbol: LETMD1
  Gene Name: LETM1 domain containing 1
  ENST ID: ENST00000548401
  CDS Start-End: 29-433
cttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcgtctctttgatcttccttgtaggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttg

SEQ ID NO: 147868 - DNA, 1389 bp, Homo sapiens
  Payload ID: 9253
  Gene Symbol: LETMD1
  Gene Name: LETM1 domain containing 1
  Uniprot ID: Q6P1Q0
  ENST ID: ENST00000550929
  CDS Start-End: 101-1015
aaagacaacctcttctctcccgcttctctcgctgtgaagatggcgctctccagggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaaggattgcagatgttatgggctgatgccaaaaaggctagaagaataaagacaaatatgtggaagcacaatataaagtttcatcaacttccataccgggagatggagcatttgagacagttccgccaagacgtcaccaagtgtcttttcctaggtattatttccattccaccttttgccaactacctggtcttcttgctaatgtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccactt

SEQ ID NO: 147869 - DNA, 705 bp, Homo sapiens
  Payload ID: 9253
  Gene Symbol: LETMD1
  Gene Name: LETM1 domain containing 1
  ENST ID: ENST00000551931
  CDS Start-End: 1-434
atcatgctttccggaagcagtcccacccagaaattattagttatttagaaaaggtcatccctctcatttctgatgcaggactccggtggcgtctgacagatctgtgcaccaagaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcag

SEQ ID NO: 147870 - DNA, 568 bp, Homo sapiens
  Payload ID: 9253
  Gene Symbol: LETMD1
  Gene Name: LETM1 domain containing 1
  ENST ID: ENST00000548209
  CDS Start-End: 31-568
ctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagttccgccaagacgtcaccaagtgtcttttcctaggtattatttccattccaccttttgccaactacctggtcttcttgctaatatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaa

SEQ ID NO: 147871 - DNA, 1713 bp, Homo sapiens
  Payload ID: 9253
  Gene Symbol: LETMD1
  Gene Name: LETM1 domain containing 1
  ENST ID: ENST00000552739
  CDS Start-End: 12-743
tcgctgtgaagatggcgctctccagggtgtgctgggctcggtcggctgtgtggggctcggcagtcacccctggacattttgtcacccggaggctgcaacttggtcgctctggcctggcttggggggcccctcggtacctgtttcccaggcaactactgatcaggcatttctggaccccaaaacaacaaactgatttcttagatatctatcatgctttccggaagcagtcccacccagaaattattagttatttagaaaaggtcatccctctcatttctgatgcaggactccggtggcgtctgacagatctgtgcaccaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacatgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgc

SEQ ID NO: 147872 - DNA, 1658 bp, Homo sapiens
  Payload ID: 9253
  Gene Symbol: LETMD1
  Gene Name: LETM1 domain containing 1
  ENST ID: ENST00000547555
  CDS Start-End: 31-156
ctcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtgagggacctgtagcgagaaaagcatttttgacgtccaggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaactaccttgggacaaggcgctgaatgaaccatggagcggatggcattgtcctgcagtcgtatagtatagcagtgcaggaacaaacagcacttgccagcaaagtctgtgtgtactgttaagtgtgtgggaggcagagagaggagcaggggccatgggcttcacagcatggcacacatgtgggaactgcagacattcctctcacagctagaactgaaacaaaccctcttgctaggggtggtccgtgtgaggtgtcatcctgtccccctcataattactaatagctggaactggcagcagcctctactgggcttttactgtgatgtgttcagttcatgtcctaggaagtcagcttttgccccaggtgggaatccttatttggcttaggactgatccacttccatgttacttacatctgtgggtttttgttgttgctgttagaaaatttgtggctggtgaaaacagcactcctttggctggagcacatgtgtccgtgcatgtacttgggtgtttccctccatcctttctgatatgaccaaaaatcaagttgttttgttttttgtcaccttcactggcatgggctaaccacttctttttcaaaccctctgaacacctttttctgatgggtaacttgcaggaatattctattggaaaagataacaggaagtacaagtgcttcttgaccccttcctcaatgtttctagccttcactctccattgtcttttctgggctgtattacagccctctgtggatcttcaactctgctgcctccactgtgatgcagcagtccaactgtaactgacagtggctgccttctctgggccatggatcacacctgtaaggtactaattactgcccagcctggggagatcaggagaggtctgcatagttagtaagttgggtttagcttttgtgtgtgcatcagtgacttagagttctgtaataacttattgtaaatgcatgaagcactgtttttaaacccaagtaaagactgcttgaaacctgttgatggaaatga

SEQ ID NO: 147873 - DNA, 601 bp, Homo sapiens
  Payload ID: 9253
  Gene Symbol: LETMD1
  Gene Name: LETM1 domain containing 1
  ENST ID: ENST00000547660
  CDS Start-End: 273-601
ctcttctctcccgcttctctcgctgtgaagatggcgctctccagggtcttcaaagcttcacctttctccaaaggcagatgtgaagaacttgatgtcttatgtggtaaccaagacaaaagcgattaatgggaaataccatcgtttcttgggtcgtcatttcccccgcttctatgtcctgtacacaatcttcatgaaagatacagcgtggtacccacccagcaatacatgatatcttggctctgagagagtgtttctctaaccatcctctgggcatgaaccaactccaggctttgcacgtgaaagccttgagccgggccatgcttctcacatcttacctgcctcctcccttgttgagacatcgtttgaagactcatacaactgtgattcaccaactggacaaggctttggcaaagctggggattggccagctgactgctcaggaagtaaaatcggcttgttatctccgtggcctgaattctacgcatattggtgaagataggtgtcgaacttggctgggagaatggctgcagatttcctgcagcctgaaagaagctgagctgtctctcttgctgcacaacgtggtcctgctctccaccaacta

SEQ ID NO: 147874 - DNA, 2213 bp, Homo sapiens
  Payload ID: 9254
  Gene Symbol: LAP3
  Gene Name: leucine aminopeptidase 3
  Uniprot ID: P28838
  ENST ID: ENST00000226299
  CDS Start-End: 275-1834
gcgggcgcacacgaatgcgggcgcacacgaatgcgggcgcacacgaatgcgggcgcacccttgagtcccctccacaaccgcggtttgatcccagcggtccagtcggccggtgctgcccatccgtcccgccccctagacgcacgtccgctcgcccggcgcccgagccagtccgcgcgcacgccgtctgcgccccgaaagccccgccccaaggcgcgcccgcccaccgctctccacgtgctcgctggagggcggtgcgaggggccgagccgacaagatgttcttgctgcctcttccggctgcggggcgagtagtcgtccgacgtctggccgtgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgctgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagcttaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaacccgaaggtcatcctcaatgccgccaccttaacaggtgccatggatgtagctttgggatcaggtgccactggggtctttaccaattcatcctggctctggaacaaactcttcgaggccagcattgaaacaggggaccgtgtctggaggatgcctctcttcgaacattatacaagacaggttgtagattgccagcttgctgatgttaacaacattggaaaatacagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaactgaaaattactatgcacttgtcagaaacaataaatgcaacttgttgtgc

SEQ ID NO: 147875 - DNA, 887 bp, Homo sapiens
  Payload ID: 9254
  Gene Symbol: LAP3
  Gene Name: leucine aminopeptidase 3
  ENST ID: ENST00000509583
  CDS Start-End: 1-359
gagtagtcgtccgacgtctggccgtgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgctgaaattattgagaagaatctcaaaagtgctagtagtaaaaccgaggtccatatcaggtaattcaggattgtgtcacagactcgagatgttacagccagaaggagcccttgagatcctaaaatccagctccctcactttttagaggaataacttgagaccagagatttgagatgacccacttgggtccacatggggagctggaatagagctgagtttgaggttctttctatctttccttgcctttgagagagagagtgccatgatatactatgtatgtgtatatttcataactgtgttattcagacacaattaacatgccatagaattcaccaatgcaaagtgtgcaattcagtgatttttttttttttttttttga

SEQ ID NO: 147876 - DNA, 626 bp, Homo sapiens
  Payload ID: 9254
  Gene Symbol: LAP3
  Gene Name: leucine aminopeptidase 3
  ENST ID: ENST00000513105
  CDS Start-End: 1-626
caaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgctgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagcttaatttgcccattaatattataggtgccatggatgtagctttgggatcaggtgccactggggtctttaccaattcatcctggctctggaacaaactcttcgaggccagcattgaaacaggggaccgtgtctggaggatgcctctcttcgaacattatac

SEQ ID NO: 147877 - DNA, 1876 bp, Homo sapiens
  Payload ID: 9254
  Gene Symbol: LAP3
  Gene Name: leucine aminopeptidase 3
  Uniprot ID: P28838
  ENST ID: ENST00000606142
  CDS Start-End: 65-1531
gcgagtagtcgtccgacgtctggccgtgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgctgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagcttaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaacccgaaggtcatcctcaatgccgccaccttaacaggtgccatggatgtagctttgggatcaggtgccactggggtctttaccaattcatcctggctctggaacaaactcttcgaggccagcattgaaacaggggaccgtgtctggaggatgcctctcttcgaacattatacaagacaggttgtagattgccagcttgctgatgttaacaacattggaaaatacagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaactgaaaattactatgc

SEQ ID NO: 147878 - DNA, 2100 bp, Homo sapiens
  Payload ID: 9254
  Gene Symbol: LAP3
  Gene Name: leucine aminopeptidase 3
  Uniprot ID: P28838
  ENST ID: ENST00000618908
  CDS Start-End: 163-1722
ctgcccatccgtcccgccccctagacgcacgtccgctcgcccggcgcccgagccagtccgcgcgcacgccgtctgcgccccgaaagccccgccccaaggcgcgcccgcccaccgctctccacgtgctcgctggagggcggtgcgaggggccgagccgacaagatgttcttgctgcctcttccggctgcggggcgagtagtcgtccgacgtctggccgtgagacgtttcgggagccggagtctctccaccgcagacatgacgaagggccttgttttaggaatctattccaaagaaaaagaagatgatgtgccacagttcacaagtgcaggagagaattttgataaattgttagctggaaagctgagagagactttgaacatatctggaccacctctgaaggcagggaagactcgaaccttttatggtctgcatcaggacttccccagcgtggtgctagttggcctcggcaaaaaggcagctggaatcgacgaacaggaaaactggcatgaaggcaaagaaaacatcagagctgctgttgcagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaagtggggatcaggaggcctggcagaaaggagtcctgtttgcttctgggcagaacttggcacgccaattgatggagacgccagccaatgagatgacgccaaccagatttgctgaaattattgagaagaatctcaaaagtgctagtagtaaaaccgaggtccatatcagacccaagtcttggattgaggaacaggcaatgggatcattcctcagtgtggccaaaggatctgacgagcccccagtcttcttggaaattcactacaaaggcagccccaatgcaaacgaaccacccctggtgtttgttgggaaaggaattacctttgacagtggtggtatctccatcaaggcttctgcaaatatggacctcatgagggctgacatgggaggagctgcaactatatgctcagccatcgtgtctgctgcaaagcttaatttgcccattaatattataggtctggcccctctttgtgaaaatatgcccagcggcaaggccaacaagccgggggatgttgttagagccaaaaacgggaagaccatccaggttgataacactgatgctgaggggaggctcatactggctgatgcgctctgttacgcacacacgtttaacccgaaggtcatcctcaatgccgccaccttaacaggtgccatggatgtagctttgggatcaggtgccactggggtctttaccaattcatcctggctctggaacaaactcttcgaggccagcattgaaacaggggaccgtgtctggaggatgcctctcttcgaacattatacaagacaggttgtagattgccagcttgctgatgttaacaacattggaaaatacagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaactgaaaattactatgcacttgtcagaaacaataaatgcaacttgttgtg

SEQ ID NO: 147879 - DNA, 1529 bp, Homo sapiens
  Payload ID: 9255
  Gene Symbol: LCMT1
  Gene Name: leucine carboxyl methyltransferase 1
  ENST ID: ENST00000380962
  CDS Start-End: 154-459
gcgtgggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagagaactgccatcagcagcgcccgacagcactctcctcctcactgcccaacactgggtggcaaatcttttcatcttggccactctgataggctggacagtgaggtccttcttcctagggcgcatggaaacctgttgcagtcacctgggtttgcggagtgggaggaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 147880 - DNA, 989 bp, Homo sapiens
  Payload ID: 9255
  Gene Symbol: LCMT1
  Gene Name: leucine carboxyl methyltransferase 1
  Uniprot ID: Q9UIC8
  ENST ID: ENST00000380966
  CDS Start-End: 150-989
gggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaa

SEQ ID NO: 147881 - DNA, 1368 bp, Homo sapiens
  Payload ID: 9255
  Gene Symbol: LCMT1
  Gene Name: leucine carboxyl methyltransferase 1
  Uniprot ID: Q9UIC8
  ENST ID: ENST00000399069
  CDS Start-End: 156-1160
cggcgtgggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccaccagtc

SEQ ID NO: 147882 - DNA, 1168 bp, Homo sapiens
  Payload ID: 9255
  Gene Symbol: LCMT1
  Gene Name: leucine carboxyl methyltransferase 1
  ENST ID: ENST00000564011
  CDS Start-End: 150-485
gggcggcgtcactgagccgcgccagctgagccaggtagggccctaccctcttctgttgctttctccctgtggctcgcgccgtcccccgccgcccgtcgaccccgcttccatgtccctggcggacacagctcccaggaacctccacgcccatggccactaggcagagggaatcctctatcacctcctgctgttccacctcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggcaagatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgt

SEQ ID NO: 147883 - DNA, 555 bp, Homo sapiens
  Payload ID: 9255
  Gene Symbol: LCMT1
  Gene Name: leucine carboxyl methyltransferase 1
  ENST ID: ENST00000572761
  CDS Start-End: 1-280
attgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacaggtcagagagcagggactgggatatccatttggacccttagtcaaccaagatatataaaggtctttctttgcagatgtgatcatggagaagccctgttcagtgcctgtcagcagcacaggctgctgagcctccatgtgggccgctagttcatgatgctgggaagaccaagtcctgcttcaccatcacatttcctacaccctattattttgactttgtattacgcaaattttcaaacaaacataaaggtagagggaatggtgaaataaacacacacgtctcatcacctaacttcagtatttcttatattatcagtgttatttcctatattcccc

SEQ ID NO: 147884 - DNA, 612 bp, Homo sapiens
  Payload ID: 9255
  Gene Symbol: LCMT1
  Gene Name: leucine carboxyl methyltransferase 1
  ENST ID: ENST00000570981
  CDS Start-End: 1-360
tcgagctgcgacgcagacgacgagggcgtgcgcggcacctgcgaagatgcttccctgtgcaagaggtttgcagtaagcattggctactggcatgacccttacatacagcactttgtgagactgtctaaagagaggaaagcccctgaaatcaacagaggatattttgctcgagtccatggtgtcagtcagcttataaaggcatttctacggaagacagaatgtcattgtcaaattgtcaaccttggggcaggcatggataccaccttctggagattaaaggatgaagatcttctcccaagtaaatattttgaggttgactttccaatgattgtcacgagaaagctgcacagtatcaagtaagtgtggcatggccagaagaacaaaagccagcgagaattcagatccagctctcaagagatggcagatctgaatgccagagacttcactttagggtgttgccttccgttcactgccccccaccaactttttttttgccctggcactcattccagcatgttctacagtctgcaaaatgcaatatacatttccttattacagatcacaggctctatggctccccatgtaattacaattaacacgaggccaaccaaa

SEQ ID NO: 147885 - DNA, 640 bp, Homo sapiens
  Payload ID: 9255
  Gene Symbol: LCMT1
  Gene Name: leucine carboxyl methyltransferase 1
  ENST ID: ENST00000576625
  CDS Start-End: 1-475
agatcttctcccaagtaaatattttgaggttgactttccaatgattgtcacgagaaagctgcacagtatcaaatgcaagcctcccctatccagccccattctagaactgcattcagaggacacacttcagatggatggacacatactggattcaaagagatatgccgttattggagcagatctccgagacctgtctgaactggaagagaagctaaagaaatgtaacatgaatacacaattgccaacactcctgatagctgaatgtgtgctggtttacatgactccagagcagtccgcaaacctcctgaagtgggcagccaacagttttgagagagccatgttcataaactacgaacaggtgaacatgggtgatcggtttgggcagatcatgattgaaaacctgcggagacgccagtgtgacctggcgggagtggagacctgcaagtcattagagtcacaggatagaatcacttgaattcctggatgaaatggagctgctggagcagctcatgcggcattactgcctttgctgggcaaccaaaggaggaaatgagcttgggctgaaggagataacttattaatctgtcgaaggcttatgccgagccagaagccgaagccacttgccctcctggaggagacc

SEQ ID NO: 147886 - DNA, 449 bp, Homo sapiens
  Payload ID: 9255
  Gene Symbol: LCMT1
  Gene Name: leucine carboxyl methyltransferase 1
  ENST ID: ENST00000575396
  CDS Start-End: 1-416
agagagccatgttcataaactacgaacaggtgaacatgggtgatcggtttgggcagatcatgattgaaaacctgcggagacgccagtgtgacctggcgggagtggagacctgcaagtcattagagtcacagaaagaacggctcctgtcgaatgggtgggaaacagcatcggccgtcgacatgatggagttgtacaacaggttacctcgagctgaagtgagcagggctgaaggagataacttattaatctgtcgaaggcttatgccgagccagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccac

SEQ ID NO: 147887 - DNA, 6957 bp, Homo sapiens
  Payload ID: 9256
  Gene Symbol: LCMT2
  Gene Name: leucine carboxyl methyltransferase 2
  Uniprot ID: O60294
  ENST ID: ENST00000305641
  CDS Start-End: 117-2177
gggaagtccaggagcatgggtggtttttttccccctaccgaggtccgtgaggtgtgtgctaaccaaggggcggctcacaaccgtgacagactgccattcctgagtctcttctggccatgggcccccggagccgtgagcgtcgggcaggcgcggtacagaacaccaacgacagcagcgccctcagcaagcgttccctggccgcgcgcgggtacgtgcaggacccctttgccgcgttgctggttccgggcgcggcgcgccgcgcaccgctcattcaccgaggctactacgtccgcgcacgcgccgtgaggcactgcgtgcgcgcttttttggagcagattggcgcgccccaggccgcgcttcgcgcgcagatcttgtctctcggcgctggcttcgactcgctctattttcgcttaaaaaccgcgggccgcctggcccgggctgcagtctgggaggtggattttccggacgtggcgcggcgcaaagcagaaaggattggagagacgccagagctgtgcgcgttaaccgggcctttcgagaggggggagcccgcgtccgcgctgtgctttgagagcgcagactactgcatcctgggtctggacttgcggcagctccagcgagtggaggaggccctgggcgccgcggggctcgacgcagcctcacccactctgctcctggccgaggcggtgctgacctacctcgagccggagagtgccgcggccctcatcgcctgggcagcccagcgttttcctaatgcccttttcgtggtctatgagcagatgaggcctcaagacgcctttggccagttcatgctgcaacattttcggcagctaaactcccccctgcatggcctggagcgttttcctgacgtggaggcgcagcggcgccgcttccttcaagctggctggaccgcctgcggtgccgtggacatgaatgaattctatcactgctttcttcccgcagaagaacgccggcgggtggaaaatattgaaccctttgacgaatttgaggagtggcatctgaagtgcgcccattatttcattctggcagcttctaggggagacaccctctcccacaccctagtgtttccatcctcagaggcatttcctcgcgtaaatcctgcttcgccttcaggggtattccctgccagcgtagtcagtagcgagggccaggtcccaaacctgaagagatatggccacgcctctgtcttcttgagcccagacgttattctcagtgcaggaggatttggagagcaggaggggcggcactgccgagtgagccagtttcacttgctctcaagagattgtgactctgaatggaaaggcagccaaataggcagttgtgggactggagttcagtgggatggacgcctttatcacaccatgacaagactctcagagagtcgggttctggttctgggagggagactgtccccagtaagtccagccttgggggttctccagcttcatttttttaagagtgaggataataacactgaggacctgaaagtgacaataacaaaggctggccgaaaggatgattccactttgtgttgttggcggcattcaacaacagaagtgtcctgtcagaatcaggaatatttgtttgtgtatgggggtcgaagcgtggtggaacctgtactaagtgactggcatttcctccatgtagggacaatggcttgggtcaggatcccagtggagggagaagtacctgaagcccggcattctcacagtgcctgcacttggcaagggggagcccttattgctggaggtctcggggcttctgaggagccattgaactctgtgctctttctgagaccaatctcttgtggattcctctgggagtcagtagacatccagcctcccattaccccaaggtactcccacacagctcatgtgctcaatggaaagctgttactggttggagggatctggattcattcctcctcatttcctggagtgactgtgatcaatttgactacaggattgagctctgagtatcagattgacacaacatatgtgccatggccattaatgttacacaaccatactagtatccttcttcctgaagagcaacagctcctgctccttggaggtggtgggaactgcttttcctttggtacctacttcaacccccatacagtcacattagacctttcttccttaagtgctgggcagtaaggactggactaatattcaggacccactaaagtagacaataaagttttccacaaataggatgaccctctagctatagatactgccactcctcctttccccatcctttttttcccttagcactattcagtgcaaaaagtgaaaaaggttggtaaaataggtaaaatacctagaaacaatcactacagaaaacagctgaagacagtggccatgcagtccgagaggagtagtggtctgcctctaattttctaatctaagttcgtttattgagttacagtggtctttagtaaagtaaaacaatttcccaatcccaggccttgtgatttgagatggtaccttagaaaaagttacacgcagttccgtggttgaatatatttgagatggtaccttagaaaaagtttcacgcagatccttggttgaatatagttgagggagcgtagtattgacaattcttcatgtaggaaacctgaaatgaacacagtcacagtttgattaaaacattgtcctgtttgttgcaacagaaaactcggatagttttaacaacaggaaacacttgtaggacttcctttaccaacatactttttaaatgttttgctattggttccatatttatttagatttataagtgtcaataaagcaaacttttgatgcctcaattcattttgcacggggtataataatgttttgttccagatatactctccacctttcactgttctgtgctccaagaggctgacctttatgggctgcatcaaggagctctctttactttttggttgagttccaccagtcagaggcaccagaggggaatgggggcaaaaagaagagtgagagtgagttggtatttattcccaattcttcccctgttggtttgcaagttggcagtggcagcattcttctgtcaaaggctacagctcctgccgtgtaatcctttcctgaagacagagttctaattctgcatcatcccaggtttcagtaattgttcctttacttcaccttttcaggcctaggagttgtgatggctctttgctagacctgaactgtactgtccaatgtggtagctattgacaacatgtgactatttaaacgaattaataaattcagtggcttagtcacattgaccacattttaagtgcttaataactatgtgtggctttggctactgtattagacaatgtagatgtagaacatttcatcgttacagaaatttctactggacactgctgactggatatcttgacttggtttcccttaaccctactcagccccttatagttagcatcccattaaactcaattatcccttttaaatgggaatctgttgcctagtgagccatgtgagatcaatgaaatagctattcatccttaaaatttgagccttaatttgtcatctaaattatgcataccttgtgaaatatacacctcaaaaaatgtagtggctttggtggtaataagtgtattactttagtatttcttcttagtcctagaaaccttagtagttttcattctacaagtgcctaaatgattattatgaaccatcattgatgacaaattgcatcctttatttctattaattttgcatataaatggatgtgaaaggtgattaatataaaaaccaagtagcaaacacaaacctaagtgtatggagaggacagtcttggctctgttagatgaagcctccccgggggagaccagctgaatgagggttgtggtataggctgggcatggtggctcacgcctataattccagcactttgggaggccaagacagaaggatcacttaaagccaggagtttaagaccagcccaggcaacaaagtcagatccccatctctacaaaaaaataagtaggcacggtggtgtgtgcttgtagtcttggatactctggaggctgaggtgatagtgagctgtgattgtgccactgcactcctgcctggttgacagagtgagaccccgtctcttaaaaagaaaaaaaaaaaaggttgttgtccaacttcagctttcctgagactttgtaagagccatttctagggaaagcattggttatggctatgactgagtcctgggaaacagggcttattacagctgggaagacatctggcaaggcgatcagtgggccaggtagtagaaaactggcagggaatatgatcagcaggagaaaatggctgttctgtatttcctgtttctaagtttactacagcacaccccagctttcaggagcagataaaagcagaacactgtgatgaggccaggcgcagtggcacatgccttgatcccagcactttgggaggccaaggctggcagatcacttgaactcaggagttggagaccagcctggccaatatggtgaaactccgtctctacccaaaaaaaaaaaaaaaaaaaaaaaaaaaaaaaaattatccatctatctatatatacaaagattagccagggatggtggcgcatgcctgtagtcccagctactcaggtactgaggtgggaggattacttgagcctggcaggtcgagccaagatcatgcaactgctctccagcttgggtgacagagtgagaccctgtctctagtaataacaacactgtaatgaaatgagtgttctcagctatgtagtagagtgtaccagaattcaaacctagatctaactccaaagcccaggttacaccttccactatgatgctgcttacatcatgccatcagccattatttcattacttttggggggaaaagaagggaggagggaggtcatctagagaatgtggacgtgtgccagacctaaattaggagtgcaatagtgcctattctcttgagcactgtccattagggcgccttatgagtaacagggcttgttctcccgagagaaattacccacatttcctataagtgattaccagattaagcatgccctccacctctaactgagcatcatgctcagttaaggaattattcatctctcgagctctactcattagagcacttagaagtattgtcagcaatatttaccctgtgcctttggagcagcattcaatatagactagcgttgaaccacagtttcattaacagtaatctgcacagttggaggtgtgagccagattgagaaccaaagctggataataattcttgcttctccatttcacttttgaagtttttgttctaaaattctgatacggagctctggagtagttatgagagttaatgaacaggtctcttcctcttttagggattacttctagaccagataaactacttaaggaaggaaagtaatttcttattttgaatctccactctgggtcagggtttcaaaaatagtgtatcataatagtgaagatgaaaacaggttaagaacaactgttggaggatatgctcttcaaggccagtgctgttgcttctttttgtactttctgagttttaaaactgagtgcccgtttttcatctttctggagctttaagtcttcttaatgatctttgggagatggtatgtatccaatatgttccaggacccaggtgtttccttggtctttttcagtgatctcagaccttgaagtcctagcttattccatatgtattttgtgatcacaaacccaacctcaagcagcccatgcttaccctgggacttatcccacatgtcatctcctggaaaacagccctatatgactgccccaaatggaaccaaccgctttctccctgtgcaagagaagcctttgaagagaagctctttgaagagtttggtgaataaaagaactagttaataaggtgaggttttttgggtttgtttgtttgtttgtttgtttgtttgctttttgttttttgttttgagacggagtcttgctctgttgcccaggctagagtgcagtggctcgatctcggctcactgcaacctccacctcctgggttcaagtgattctcctgcctcggcttccggagtagctggaattacaggtgcgcaccaccatgcccggctaattttttttttatttatttttagtagagatggggtttcaccatgttggtcaggctggtatccaactcctgacctcaagtgatctgcccgcctcggcctcccaaagtgctgagattacaggcgtgagccaccatgcctggcctaggtgggtttttaaccatagggacagtccaataatgtctagtttgactttaagattaagccttttaacttcagtaatgaaggaaggggtgtaaaatagcattaagccggcaagttaggtcatgtaacttggctaatcacattagacttgatgtttaaagagagaaggagagtgtgtagagcaggaattatgaaatttataatcagctttagagtaggctgagatttccttggatgtcaataattatgagtaaacaagaattctgtcatcccacatgtaagtaagcagttacaagactgcttacttatctgtcttggacattgatagaaagcacatgattgggaaggggcagttccttgactgagggaaggaattgtgtctggttcacttttctatcaccaacatagtagatgctcaacaaatacttgttggatagaggtccactcttgtactcaaataaattatatttgaatattactatagttcttatgcacaaactgatgtcaataactcctgtaattgttgtgtatgtgtgtgtgtcagggggaggtaagcattaaaattttaaagaacccacagtttaagagtctttggaaatacattcaacttttctgacccaggtaaaggtggtagactttctggtgtcatttctatctttatggaataaacctgaaccttctccctga

SEQ ID NO: 147888 - DNA, 1545 bp, Homo sapiens
  Payload ID: 9256
  Gene Symbol: LCMT2
  Gene Name: leucine carboxyl methyltransferase 2
  ENST ID: ENST00000567039
  CDS Start-End: 94-213
tttttttccccctaccgaggtccgtgaggtgtgtgctaaccaaggggcggctcacaaccgtgacagactgccattcctgagtctcttctggccatgggcccccggagccgtgagcgtcgggcaggcgcggtacagaacaccaacgacagcagcgccctcagcaagcgttccctggccgcgcgcggaagaacgccggcgggtggaaaatattgaaccctttgacgaatttgaggagtggcatctgaagtgcgcccattatttcattctggcagcttctaggggagacaccctctcccacaccctagtgtttccatcctcagaggcatttcctcgcgtaaatcctgcttcgccttcaggggtattccctgccagcgtagtcagtagcgagggccaggtcccaaacctgaagagatatggccacgcctctgtcttcttgagcccagacgttattctcagtgcaggaggatttggagagcaggaggggcggcactgccgagtgagccagtttcacttgctctcaagagattgtgactctgaatggaaaggcagccaaataggcagttgtgggactggagttcagtgggatggacgcctttatcacaccatgacaagactctcagagagtcgggttctggttctgggagggagactgtccccagtaagtccagccttgggggttctccagcttcatttttttaagagtgaggataataacactgaggacctgaaagtgacaataacaaaggctggccgaaaggatgattccactttgtgttgttggcggcattcaacaacagaagtgtcctgtcagaatcaggaatatttgtttgtgtatgggggtcgaagcgtggtggaacctgtactaagtgactggcatttcctccatgtagggacaatggcttgggtcaggatcccagtggagggagaagtacctgaagcccggcattctcacagtgcctgcacttggcaagggggagcccttattgctggaggtctcggggcttctgaggagccattgaactctgtgctctttctgagaccaatctcttgtggattcctctgggagtcagtagacatccagcctcccattaccccaaggtactcccacacagctcatgtgctcaatggaaagctgttactggttggagggatctggattcattcctcctcatttcctggagtgactgtgatcaatttgactacaggattgagctctgagtatcagattgacacaacatatgtgccatggccattaatgttacacaaccatactagtatccttcttcctgaagagcaacagctcctgctccttggaggtggtgggaactgcttttcctttggtacctacttcaacccccatacagtcacattagacctttcttccttaagtgctgggcagtaaggactggactaatattcaggacccactaaagtagacaataaagttttccacaaataggatgaccctctagctatagatactgccactcctcctttccccatcctttttttcccttagcactattcagtgcaaaaagtgaaaaa

SEQ ID NO: 147889 - DNA, 1854 bp, Homo sapiens
  Payload ID: 9257
  Gene Symbol: LURAP1
  Gene Name: leucine rich adaptor protein 1
  Uniprot ID: Q96LR2
  ENST ID: ENST00000371980
  CDS Start-End: 94-813
ggttttgctccgctttagcagcggcgaagggaggacccccgggagccggtccccggcgtccggtcgcccagcccttttcaggcttgggcccgcatggaggggaccgtggagtcccagacgcctgacctgcgggatgtggagggtaaggtgggcaggaagacccctgaagggctgctccgcgggctgcgaggcgagtgtgagctgggaacctctggcgccctgctgctcccaggggcgtctagcaccggccacgacttgggggacaagatcatggcgctgaagatggagctggcttacctgcgagccatcgatgtgaagatcctgcagcagctggtgaccttgaatgagggcatcgaggcagtgcgctggctgttggaggagcgggggacgttgaccagtcattgcagcagcctcaccagcagtcaatatagcctgacaggcgggagcccaggccgctcaaggcgaggcagctgggacagcctgccagacaccagcaccaccgaccggctggacagtgtctctattggcagcttcctggacacagtggcccccagcgagctggatgaacagggcccacctggggctccacgttccgagatggactgggcaaaagttatagctggtggagagagggccaggactgaggtggatgtggcagccaccaggctagggagcttgagagctgtgtggaagcccccaggggagaggcttcaaggtggaccacctgagtcaccagaggatgagagtgccaagctgggcttcgaggcccactggttctgggagcagtgccaggatgatgtgaccttcttgtaacaactattccacccttttgtaatcctgtggctcttttatccattagatgtggtctcccccaaaattgattctccctcagtctgagactaggaagaggctgcactgaaatcagttaccatggaaacctggctcatcatttctctagtccctagggagtctctgcctttatccctcaattattgggtccctagagctagcttgctctttctttctttctttctttttttgagacagggtcttatgctgttacccaagatagagagcagtggcatgatcacagctcactgcagccttgacctcctgggctcaagcgatcctcctatttcagcctcccccatagttaggaccacaggcatgcaccaccatgcccagctaattgtttatttatttattttttttttgtagagatagggtttccctgtgttgcccaggctggtctcaaactcctgggctcaagggatcctcccgcctcagcctcccaaagtgctgggattatgcccagcccctagagatacttctatagagatattgactctaaaggattgacctatggcttttggtatttagtatctctcactactccccccagctaagtaaggatttaaggaatttaggactccctggagttaacagatgaagagatgggggcataattacttcacccaaagtctagaagccttggcctctctcttggccaagatggaggattgaggagggacatggaccttcaggactaaccctctatggattggccctcccagaagcgtttgggctggtagacccaccccttcctacctgctgagtgatgtcatttcctgccaggatgggtagccctttgtacgggtccttggatggtagtaggtcatataggggcatctgagcccctgctgctaagtgagatcacattatttatcgtccataccattacttcttgtgaacagtaacatgtcactcctcctggcaggaaagtttctcattgtcagatgtttgtgcttcttttcaggtcttactttttaaatagagtgttctcattttatccta

SEQ ID NO: 147890 - DNA, 1753 bp, Homo sapiens
  Payload ID: 9258
  Gene Symbol: LURAP1L
  Gene Name: leucine rich adaptor protein 1-like
  Uniprot ID: Q8IV03
  ENST ID: ENST00000319264
  CDS Start-End: 696-1382
atgacttggatcaaacagcctaaatgggaagaaggacatttttgctgcatcaaggaagccgttaaactcctgctaagctaactagctcttttttatgggtccatgcacacgaccgaactcctctttcactgaccagagattatttctgacaacccaggatatcccgaaagcttggaggcatatggctggaaaatgaaacgacccaggacatcgtttctggctgcatcattattttgtgtcgcgtagtaccagatgggcagtcagtgagcggcgcagggatgtgaacggacggttttataatgtgaaaattttcccttggtaaagctaaaacagatttaatttccctctcttttctttcactacttccccctctttattccccctctgtctgcaatatcagtgaactcaactttgcagtgaggtggccaaaaagagagagaatgaggagatcttgatcatcttagtgtcggaggagtcgcagcggactgggaactgcagctgcgaccccccgcgtcctgtgcggatttcagggctgataccgcataggcggttatggaaaggacggtacaccggagcggcggaggatagagaccctggcccccggagaggtctgctgatttcgcagcagccttcgaagccgtggctgcctttcatctgctgcgttttattactattatcgccgttccggaaaagtcatggaagacagcccgctgccagacctcagagacatcgagctgaagctggggcgcaaagtacccgagagtctagtgcgctctctccgtggggaggagccggttcccagggaaagggacagggacccctgcggggggagcggtggtggtggcggcggcggcggcggctgcagtagcagcagcagctactgcagcttccctccctccttgtcgtcctcctcttcgtcctccccaacctctggctccccacgaggtagccactctagcgccctggagaggctagaaaccaagcttcacctcctcaggcaagagatggttaacctcagagccacagacgtcaggctcatgcgccagttgcttgtaatcaatgagagcatcgagtccatcaagtggatgatcgaagaaaaagccaccattaccagcagaggcagcagcctcagtggcagcctgtgcagtttgttggagagtcagagcacctccttacgtggcagctacaacagcctacacgatggcagtgatgggctggatggcatttccgtgggaagttatctggacacgttggcggatgatgtcccaggccatcagaccccttcagacttggaccaattcagtgacagctccctcatagaggactcacaggcactacacaagcgtcctaaattggattctgaatactactgctttggctagtgacagttttttgcatgggactggtgtgcaatgaacttgtatttatccttcttctccgctgctatatttttggtgtgatttttattttaataagatgacctttttaaaagaagctgattttgaaactgcttaatggtattgctgttgctcctaatacttctcatctgagctgatttatttttctctgttacatctctattttttatttattacaatgattttctcccttcttttacagtagcacaaacaaagtagggggaaaagaataagcaataattatgtttttgcttttgttttcagagcaatgggtcagggattacaagaaaaactttgctaaattttacaataaaccaaagtctgataacagttaa

SEQ ID NO: 147891 - DNA, 910 bp, Homo sapiens
  Payload ID: 9259
  Gene Symbol: LRCOL1
  Gene Name: leucine rich colipase-like 1
  ENST ID: ENST00000622710
  CDS Start-End: 66-206
ttggcctgtctcacctctacacagaggggctgctggcgcctgacggaaaaaggtccacacacccgatggccggcccggggtggacgctgctgctactgctgctgctgctgctgctgctggggtccatggcagggtatgggccacagaagaagttgaacctgtcccataagaaacttctcaggaaacccaagtttgaaggatggtgacacaggggagccaaggagagggcaggcctttcctgagtgctgagtctgcaggccctgcccaggaacaggtgagcgagctggtgagtggtgtttcagggcatcggggagccatgcaggagacacgaggagtgccagagcaactgctgtaccatcaacagcctggccccacacacgctctgcacccctaagaccatcttcctgcagtgcctgccctggaggaagcccaatgggtacagatgctcgcacgactcagagtgccagagcagctgctgcgtccgcaacaacagcccgcaggagttgtgcacgccccaaagcgtcttcctgcagtgtgtgccctggcgcaagcccaacggcgacttctgcagcagccatcaggagtgtcacagccagtgctgcatccagctgagggagtacagccccttccgctgcattccccggaccgggatcctggcccagtgcctgcccctgtgatgtgagctcgaacctgggcgcgagggaccggcctgggccctgggatgttcacgcaggaccgcgttgcgcgggggctggttccagcggaagcttcccttacggtttgtgctgctgtttctggggctctgaaaatctgtgggaactgaaaggctgtgaccagcctggtggcgcgaagtgtctgtgagaacaaatcccaggcactggggtgtagcctgattgttaaacatcaataa

SEQ ID NO: 147892 - DNA, 778 bp, Homo sapiens
  Payload ID: 9259
  Gene Symbol: LRCOL1
  Gene Name: leucine rich colipase-like 1
  Uniprot ID: A6NCL2
  ENST ID: ENST00000376608
  CDS Start-End: 66-545
ttggcctgtctcacctctacacagaggggctgctggcgcctgacggaaaaaggtccacacacccgatggccggcccggggtggacgctgctgctactgctgctgctgctgctgctgctggggtccatggcagggtatgggccacagaagaagttgaacctgtcccataagggcatcggggagccatgcaggagacacgaggagtgccagagcaactgctgtaccatcaacagcctggccccacacacgctctgcacccctaagaccatcttcctgcagtgcctgccctggaggaagcccaatgggtacagatgctcgcacgactcagagtgccagagcagctgctgcgtccgcaacaacagcccgcaggagttgtgcacgccccaaagcgtcttcctgcagtgtgtgccctggcgcaagcccaacggcgacttctgcagcagccatcaggagtgtcacagccagtgctgcatccagctgagggagtacagccccttccgctgcattccccggaccgggatcctggcccagtgcctgcccctgtgatgtgagctcgaacctgggcgcgagggaccggcctgggccctgggatgttcacgcaggaccgcgttgcgcgggggctggttccagcggaagcttcccttacggtttgtgctgctgtttctggggctctgaaaatctgtgggaactgaaaggctgtgaccagcctggtggcgcgaagtgtctgtgagaacaaatcccaggcactggggtgtagcctgattgttaaacatcaataa

SEQ ID NO: 147893 - DNA, 921 bp, Homo sapiens
  Payload ID: 9259
  Gene Symbol: LRCOL1
  Gene Name: leucine rich colipase-like 1
  ENST ID: ENST00000545517
  CDS Start-End: 14-199
gtccacacacccgatggccggcccggggtggacgctgctgctactgctgctgctgctgctgctgctggggtccatggcagggtatgggccacagaagaagttgaacctgtcccataagccccgggcccccagcactgacctgccagaaccacggcagtctgggtttgttccagaaacttctcaggaaacccaagtttgaaggatggtgacacaggggagccaaggagagggcaggcctttcctgagtgctgagtctgcaggccctgcccaggaacaggtgagcgagctggtgagtggtgtttcagggcatcggggagccatgcaggagacacgaggagtgccagagcaactgctgtaccatcaacagcctggccccacacacgctctgcacccctaagaccatcttcctgcagtgcctgccctggaggaaggtgagcccaatgggtacagatgctcgcacgactcagagtgccagagcagctgctgcgtccgcaacaacagcccgcaggagttgtgcacgccccaaagcgtcttcctgcagtgtgtgccctggcgcaagcccaacggcgacttctgcagcagccatcaggagtgtcacagccagtgctgcatccagctgagggagtacagccccttccgctgcattccccggaccgggatcctggcccagtgcctgcccctggtaagtcccgggcgggggctcagcctccaggccctcccttggccgccacagggaagtcgcacagaaacacagcaactggaccgggaccgcggctgtgagaggtgggctctgagcacccaggcacccctgctgggagaggccggcgcttcaccgcccatctcataaggtgggggccgcagagaaggctcctgggctggcactgagcccaccaggccccgcagggcacgggtgcccggtca

SEQ ID NO: 147894 - DNA, 825 bp, Homo sapiens
  Payload ID: 9259
  Gene Symbol: LRCOL1
  Gene Name: leucine rich colipase-like 1
  ENST ID: ENST00000544018
  CDS Start-End: 89-508
gcgtctcgtctagaagctgcagcttggcctgtctcacctctacacagaggggctgctggcgcctgacggaaaaaggtccacacacccgatggccggcccggggtggacgctgctgctactgctgctgctgctgctgctgctggggtccatggcagggtatgggccacagaagaagttgaacctgtcccataagggcatcggggagccatgcaggagacacgaggagtgccagagcaactgctgtaccatcaacagcctggccccacacacgctctgcacccctaagaccatcttcctgcagtgcctgccctggaggaaggtgagcccaatgggtacagatgctcgcacgactcagagtgccagagcagctgctgcgtccgcaacaacagcccgcaggagttgtgcacgccccaaagcgtcttcctgcagtgtgtgccctggcgcaagcccaacggcgacttctgcagcagccatcaggagtgtcacagccagtgctgcatccagctgagggagtacagccccttccgctgcattccccggaccgggatcctggcccagtgcctgcccctgtgatgtgagctcgaacctgggcgcgagggaccggcctgggccctgggatgttcacgcaggaccgcgttgcgcgggggctggttccagcggaagcttcccttacggtttgtgctgctgtttctggggctctgaaaatctgtgggaactgaaaggctgtgaccagcctggtggcgcgaagtgtctgtgagaacaaatcccaggcactggggtgtagcctgattgttaaacatcaataaaggctcctggccgactgag

SEQ ID NO: 147895 - DNA, 4370 bp, Homo sapiens
  Payload ID: 9260
  Gene Symbol: LRRFIP1
  Gene Name: leucine rich repeat (in FLII) interacting protein 1
  Uniprot ID: Q32MZ4
  ENST ID: ENST00000244815
  CDS Start-End: 241-2595
ccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggaagacagtgagcgctactctcgtagatccagaagaaacacatcggcttctgatgaagacgagcgcatgtcagtgggtagtcgtggaagcctgagggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgcaa

SEQ ID NO: 147896 - DNA, 3709 bp, Homo sapiens
  Payload ID: 9260
  Gene Symbol: LRRFIP1
  Gene Name: leucine rich repeat (in FLII) interacting protein 1
  Uniprot ID: Q32MZ4
  ENST ID: ENST00000289175
  CDS Start-End: 312-2570
gcgtggggggcggggcgggccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaaaa

SEQ ID NO: 147897 - DNA, 2775 bp, Homo sapiens
  Payload ID: 9260
  Gene Symbol: LRRFIP1
  Gene Name: leucine rich repeat (in FLII) interacting protein 1
  Uniprot ID: Q32MZ4
  ENST ID: ENST00000308482
  CDS Start-End: 70-1992
ggggccgggccggggcggcgcgagcggctggagcaacgggccccgcggcagctgcgggcgacgcggtcgatggacatgggcacccagggatcggggcgcaagcggctccccaaccgggagcggctcacggcggaggacgacgcgctcaaccagatcgcgcgggaggcggaagcccggctcgctgcaaaacgggcggcccgcgcggaggctcgcgagatccgcatgaaggagctggagcggcagcagaaggagatctatcaggtccaaaagaaatattatgggctggatacaaaatggggtgacatcgagcagtggatggaagacagtgagcgctactctcgtagatccagaagaaacacatcggcttctgatgaagacgagcgcatgtcagtgggtagtcgtggaagcctgaggtcgcagcctgacttggagtatgggggtccttacgcctggacaaatggttatgatggagaattgtatggatcacagtccctgaatagaagatctggcaggccctcctgtctgtacagcgctgcccggccttcggggagttaccgggcgtctgtgttggatgaaggcagcttcggtgggacccgacggggcagcacctccggctcccgtgctccctcggagtacagcggccacctcaactccagctcccgcgcctcctccagggccagctcggcccgggccagccctgtggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggaactcaatgagttaaaggaccagattcaggatgtagaaggcaaatacatgcagggattgaaagagatgaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgaggaaatccgacagctacagcagaaacaggcgagttctatcagggagatttctgatcttcaggaaacaatagagtggaaagacaaaaagataggggcattagagaggcagaaagagttctttgattccgtaaggagtgaacgggatgatcttagagaagaagtagtcatgctgaaagaggaattaaagaaacatggaataatcctaaattcagaaatagctaccaatggagagacttccgacaccctcaataatgttggataccaaggtcctaccaagatgacaaaagaagagttaaatgccctcaagtcgacaggggatgggaccctagatattaggttgaaaaagctggttgatgaacgggaatgcttattggaacagattaagaaactcaaagggcagctggaggagagacagaagattggcaaactagacaatcttcgatctgaagatgatgtcttggaaaacgggacagacatgcatgtaatggacctacaaagggatgccaacagacagatcagcgacctcaaatttaaacttgcaaaatctgagcaagagataactgcattagaacaaaatgtaataaggttagagagtcaagtatcacgttacaaatcagcggctgaaaatgcagaaaaaatagaagatgaacttaaggcagaaaaacggaaactccaaagagagctccgctctgcattggataaaacagaagagctcgaggtgagcaacggccacttagtgaagcgtctggaaaaaatgaaagcaaatcggagtgcactcttgtcccagcagtaaattccagctctgatcaggcaactggttggtgactggagagcattgtttcataggcttttctctgtcctatctgggagcgctgcttcttcccctgccttccgagagacgaagaccgtggcgagcttggcgcttaggggctcccgtgccatggctcaccccagggagccccagcagccaccaggtgcctctgtctgcagacccctggcccgggctggcgccgacgctcagaacctgcaggtacttcataagcacacaggggcctcgagggagctctgtgtctgaccgcacagcagcctctgaatgccgctggaagtgatgatcaaagtaaagattcagttgggacttgagttttttttttttttcatgtgtcttgctgaagattaaggggaaatgttacagtgttgggacttcctttcatggcagaatctacaatttgagcgacttcagtagtatctcttagtctacgcttttcatacacaaaacactgtggaaccacaagccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaaatgacagcttttcattgcattatttaatccttatatttggaattgaagtcgttaacttcttttaaagaatgtactattagaaaaattaaaaatgaaatgttgagagacttca

SEQ ID NO: 147898 - DNA, 3365 bp, Homo sapiens
  Payload ID: 9260
  Gene Symbol: LRRFIP1
  Gene Name: leucine rich repeat (in FLII) interacting protein 1
  Uniprot ID: Q32MZ4
  ENST ID: ENST00000392000
  CDS Start-End: 118-2544
cggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggaagacagtgagcgctactctcgtagatccagaagaaacacatcggcttctgatgaagacgagcgcatgtcagtgggtagtcgtggaagcctgagggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggaactcaatgagttaaaggaccagattcaggatgtagaaggcaaatacatgcagggattgaaagagatgaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagt

SEQ ID NO: 147899 - DNA, 570 bp, Homo sapiens
  Payload ID: 9260
  Gene Symbol: LRRFIP1
  Gene Name: leucine rich repeat (in FLII) interacting protein 1
  ENST ID: ENST00000420665
  CDS Start-End: 124-570
acttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggcggaagcccggctcgctgcaaaacgggcggcccgcgcggaggctcgcgagatccgcatgaaggagctggagcggcagcagaaggaggaagacagtgagcgctactctcgtagatccagaagaaacacatcggcttctgatgaagacgagcgcatgtcagtgggtagtcgtggaagcctgaggacaaatggttatgatggagaattgtatggatcacagtccctgaatagaagatctggcagggtagaagagagaccagaaaaagattttactgagaaggggtctcgtaacatgccgggcctgtctgcagccacgctggcctctctgggtgggacttcctctcggagaggcagcggagacacctccatctccatcgacacc

SEQ ID NO: 147900 - DNA, 3208 bp, Homo sapiens
  Payload ID: 9261
  Gene Symbol: LRRFIP2
  Gene Name: leucine rich repeat (in FLII) interacting protein 2
  Uniprot ID: Q9Y608
  ENST ID: ENST00000336686
  CDS Start-End: 82-2247
tggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagagtactctcttcattcctttgatcggaagtggggacagattcagaagtggctggaagattcggaaagggccaggtattcccaccggtccagtcaccatcgtccttatctgggagttgaggatgcattgtccattcgaagtgttggcagtcacaggtatgatatgttcaaggatagatcatcaagactttcatcattaaatcattcttacagtcactctcatggaatgaagaagaggtcttctgattctcataaagacctactgagtggcctctactttgaccagagaaactatagcagtcttagacatagcaaacccacctctgcctactacactcggcagtcttcttccctgtacagtgaccctctggcaacatataagagtgacagggcctctcctactgcaaattctggtctgctgagaagtgccagtctggcatcattgtacaatggtggattatataacccttatggtcctcgaactccatctgaatgcagttattattcatcaagaataagttcagcccgaagcagtccagggtttaccaacgatgacactgcaagcattgtgtcttctgatcgtgccagtcgtggacgaagggagagtgtggtatctgccgctgattatttcagtcgctccaatcgtaggggaagtgttgtctctgaggtggatgatatcagtatcccagatttgtccagcttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgaggagaagcagcgcatgcagcagaaaatagacaccatgacaaaagaggtgtttgacctccaggagacacttctttggaaagataaaaaaattggggccctagagaaacagaaagaatacattgcctgccttaggaatgagcgagatatgctcagagaggagctggctgacctgcaggagacagtgaagacgggagagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaattggctactgacatgttcattttgttataggagactttaaaacaaatcatggcaaccacatccctcttcttttgtctccttctcaaggaaaaacaatctggaatgtagaacttt

SEQ ID NO: 147901 - DNA, 2821 bp, Homo sapiens
  Payload ID: 9261
  Gene Symbol: LRRFIP2
  Gene Name: leucine rich repeat (in FLII) interacting protein 2
  Uniprot ID: Q9Y608
  ENST ID: ENST00000354379
  CDS Start-End: 424-1626
gtcgtcgaccctgtggccccgcccatccttcgcctcctcagtcggccgctcaggctgcggctcctcccggggccggttcccgctgtctcagccgcggcgcagagggcacatcggcctgaccgactagccggctgccagtgccgggagccgccgcgtccatccccgcccgcctggccggggacccaggactgagtcgtccagctgcgcccctcgcccatagccccagcgggcgccgggcgggcgagcagctcttcggcccttcccggacagcgacgcagtcgcagcgcgcgccctaacacagatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagagttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaattggctactgacatgttcattttgttataggagactttaaaacaaatcatggcaaccacatccctcttcttttgtctccttctcaaggaaaaacaatctggaatgtagaacttttaaagacttgagtttcacctttagaggtaccctgtccaagaggtttttttaaaatcatggagtgcaactactttgcagaatttatgattctcttttgctcttagtacccaggtggttttatagaaatgattattgtatctttaaagtgcttacacagaaaatatattgggggaaaatctagtgactaaaggcacataagataataaaactagactttaaaaaggtaactcaaaa

SEQ ID NO: 147902 - DNA, 1791 bp, Homo sapiens
  Payload ID: 9261
  Gene Symbol: LRRFIP2
  Gene Name: leucine rich repeat (in FLII) interacting protein 2
  Uniprot ID: Q9Y608
  ENST ID: ENST00000396428
  CDS Start-End: 150-1661
aatgaaacaagagagaaggagagcgggatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagaggaagattcggaaagggccaggtattcccaccggtccagtcaccatcgtccttatctgggagttgaggatgcattgtccattcgaagtgttggcagtcacaggaatcattcttacagtcactctcatggaatgaagaagaggtcttctgattctcataaagacctactggcatcattgtacaatggtggattatataacccttatggtcctcgaactttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgaggagaagcagcgcatgcagcagaaaatagacaccatgacaaaagaggtgtttgacctccaggagacacttctttggaaagataaaaaaattgggaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtatttt

SEQ ID NO: 147903 - DNA, 352 bp, Homo sapiens
  Payload ID: 9261
  Gene Symbol: LRRFIP2
  Gene Name: leucine rich repeat (in FLII) interacting protein 2
  ENST ID: ENST00000452742
  CDS Start-End: 176-352
taatgggaagagaatgtggatgtagtaatgaaacaagagagaaggagagcgggatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagag

SEQ ID NO: 147904 - DNA, 1989 bp, Homo sapiens
  Payload ID: 9261
  Gene Symbol: LRRFIP2
  Gene Name: leucine rich repeat (in FLII) interacting protein 2
  Uniprot ID: Q9Y608
  ENST ID: ENST00000440230
  CDS Start-End: 614-1888
ggctgcggctcctcccggggccggttcccgctgtctcagccgcggcgcagagggcacatcggcctgaccgactagccggctgccagtgccgggagccgccgcgtccatccccgcccgcctggccggggacccaggactgagtcgtccagctgcgcccctcgcccatagccccagcgggcgccgggcgggcgagcagctcttcggcccttcccggacagcgacgcagtcgcagcgcgcgccctaacacaggtaagggccgctcctcccgccagcccggtgggagcagggagcggggagttgggaacctttttcccggcctccgcagtcccgtgggatccgcgccgcctccgacctcggctagggggccgggcttccctggggactggccggcccgcggcgggctcccgggctggggtcgccccctgcctgcggcgttctcagacatcccgtctgatttctaacgctcacccttccaccgcgctggggaaaagatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagagttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttt

SEQ ID NO: 147905 - DNA, 961 bp, Homo sapiens
  Payload ID: 9261
  Gene Symbol: LRRFIP2
  Gene Name: leucine rich repeat (in FLII) interacting protein 2
  ENST ID: ENST00000416425
  CDS Start-End: 287-961
atggcggaacagggagccaggggcatcgccgcttggggaacctcacccgccggcccagggctcagctcgccgtgtgacagccccgggtactttgcccagcggggtgcaagcccggaccgcggcaagcgccactcccgggcagtcgcggccacaactgcttccggatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagagttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgag

SEQ ID NO: 147906 - DNA, 560 bp, Homo sapiens
  Payload ID: 9261
  Gene Symbol: LRRFIP2
  Gene Name: leucine rich repeat (in FLII) interacting protein 2
  ENST ID: ENST00000438374
  CDS Start-End: 358-560
atcggcctgaccgactagccggctgccagtgccgggagccgccgcgtccatccccgcccgcctggccggggacccaggactgagtcgtccagctgcgcccctcgcccatagccccagcgggcgccgggcgggcgagcagctcttcggcccttcccggacagcgacgcagtcgcagcgcgcgccctaacacagatgtgggaagataaatgaaggggtctagatgtaaatgtcagtggaaaggagagctaccatcactaaggtttatattctgcaagatcctgaagatactttccttcttttctggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagaggaagattcggaaagggccaggtattc

SEQ ID NO: 147907 - DNA, 545 bp, Homo sapiens
  Payload ID: 9261
  Gene Symbol: LRRFIP2
  Gene Name: leucine rich repeat (in FLII) interacting protein 2
  ENST ID: ENST00000440742
  CDS Start-End: 1-545
gttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgaggccctagagaaacagaaagaatacattgcctgccttaggaatgagcgagatatgctcagagaggagctggctgacctgcaggagacagtgaagacgggagagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccagga

SEQ ID NO: 147908 - DNA, 389 bp, Homo sapiens
  Payload ID: 9261
  Gene Symbol: LRRFIP2
  Gene Name: leucine rich repeat (in FLII) interacting protein 2
  ENST ID: ENST00000436858
  CDS Start-End: 213-389
gaagagaatgtggatgtagtaatgaaacaagagagaaggagagcgggatgtgggaagataaatgaaggggtctagatgtaaatgtcagtggaaaggagagctaccatcactaaggtttatattctgcaagatcctgaagatactttccttcttttctggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagag

SEQ ID NO: 147909 - DNA, 2522 bp, Homo sapiens
  Payload ID: 9261
  Gene Symbol: LRRFIP2
  Gene Name: leucine rich repeat (in FLII) interacting protein 2
  Uniprot ID: Q9Y608
  ENST ID: ENST00000421276
  CDS Start-End: 401-1675
catccttcgcctcctcagtcggccgctcaggctgcggctcctcccggggccggttcccgctgtctcagccgcggcgcagagggcacatcggcctgaccgactagccggctgccagtgccgggagccgccgcgtccatccccgcccgcctggccggggacccaggactgagtcgtccagctgcgcccctcgcccatagccccagcgggcgccgggcgggcgagcagctcttcggcccttcccggacagcgacgcagtcgcagcgcgcgccctaacacagatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagagttggatgaaaaatctgacaaacagtatgctgaaaattatacaagaccttcatctcgaaattctgcctcagcaacaacccctctaagtggaaactcatccagacgaggaagtggggacaccagcagcttaatagatccagacacttcattaagtgaattgcgggatatctatgaccttaaggaccagatacaggatgtagaagggagatacatgcaggggcttaaagaactaaaggaatctttgtctgaagtggaagaaaaatacaagaaagccatggtttccaatgcacagttagacaatgagaagaacaatttgatctaccaagtagacacactcaaggatgttattgaagagcaggaggaacagatggcagaattttatagagaaaatgaagaaaaatcaaaggagttagaaaggcagaaacatatgtgtagtgtgctgcagcataagatggaagaacttaaagaaggcctgcggcaaagagatgagcttattgagaaacatggcttagttataatccccgatggcactcccaatggtgatgtcagtcatgaaccagtggctggagccatcactgttgtgtctcaggaagctgctcaggtcttggagtcagcaggagaagggccattagatgtaaggctacgaaaacttgctggagagaaggaagaactactgtcacagattagaaaactgaagcttcagttagaggaggaacgacagaaatgctccaggaatgatggcacagtgggtgacctggcaggactgcagaatggctcagacttgcagttcatcgaaatgcagagagatgccaatagacaaattagcgaatacaaatttaagctttcaaaagcagaacaggatataactaccttggagcaaagtattagccggcttgagggacaggttctgagatataaaactgctgctgagaatgctgagaaagttgaagatgaattgaaagcagaaaaacggaagctacaacgagagttacgaacagcactggacaagattgaggagatggagatgaccaacagccacctggccaagcggctggagaagatgaaggccaataggacagcacttctggcccagcagtaggaaaaccacccttcaacctgggtgatgctccttggggccctacctagagggactgacttttgtccattgacacaaaccccttttagtactgttttgagttttgtcattaaaacagccacctttgtattttataatttatgacagaatgaagtcattttgaatctacatgaatgaacactttggattttgttgtagtttgattctagggtagaaccagtccatgctgtttttattttttatctccgtaattgtagaatcatgtttactcaacgtttttccccagctgcctcagtaactgggcactcggaggccttggcacgggttctggaggacagacagcaattctatgagtgctcactgagatacttgctggagacctcagaaaacacaagtgccttctccacggtgcaattcagacttcagtgatctccagtggtcaaaagacatttacccttaatatcagacaacatttatattttagtgaagaaacaagttctcgggtggggaatctatgtttcactcagatttatatgtttggaggaaaaaagcctttttttgtaaaatatttaaatttatataagaaaatgttagaaaaaaatatggggagtgtatataaaacttgctttattgcatggggcaggggaagtccaggcctaatactcctaaagtaagagttgggtcctttttttcttcaatacaactgtgctgtaccttgtaaagtattttatctgctgcttatttgtggaatgaaacctcaaacaaacccaaagggggagggtagggcagggcaggcagattggaaatctgcctgcagattctattaaatacacccttttgccaaccacaa

SEQ ID NO: 147910 - DNA, 718 bp, Homo sapiens
  Payload ID: 9261
  Gene Symbol: LRRFIP2
  Gene Name: leucine rich repeat (in FLII) interacting protein 2
  ENST ID: ENST00000434749
  CDS Start-End: 542-718
gtttaaaataatattttttcaagataacattttattttgaggataaatctatatgaaaaagtgcagttattggagaatgcagtgttgcaaatagaattagttggcagggactccacggttgttgtggtttgaatatcttgcagcactaaccctgtttaaccaacgtcatgctctgtttaacagatgcagagataatgacctagtattataatatgtagaataagaatttcagaaagtgtgattcatttcgaaggtagatcactcactttgtgaatcattgctatgaatctgaaaattgaaatagaggaaacctaagttcgtatctgcctaatgagatggcattctttactcattttataggaagtgttgtattatgttttgttaggtctgttgctggatatttatcatcgtgaagaatgatgtgggaagataaatgaaggggtctagatgtaaatgtcagtggaaaggagagctaccatcactaagggctgaaaacacagttaaatcactttcaaagttaaaagactattaagaacacaagatggggactcctgcttctggaaggaaaagaacacctgtgaaagaccgattttctgcagaagatgaagctttgagtaacattgccagagaggcagaggcaaggctggcagcaaaacgggctgcccgggcagaagcaagagatatacgcatgagagaactggaacgacaacaaaaagag

SEQ ID NO: 147911 - DNA, 3813 bp, Homo sapiens
  Payload ID: 9262
  Gene Symbol: LRRCC1
  Gene Name: leucine rich repeat and coiled-coil centrosomal protein 1
  Uniprot ID: Q9C099
  ENST ID: ENST00000360375
  CDS Start-End: 150-3248
gggaaagttcccggctgtcggttggagggtgggtcctcgccccgccccgccccctcgggccgcccttccgcgcttccgggaggcttgtcccaagctcacggacccctcgctgggtgccggttaagaccccgctccccgtcgccagtgctatggaggcggcggcggcggtggtggcggcagaggcggaagtggaaaacgaagacggcgacagcagctgcggggatgtatgcttcatggacaaaggcttgcagagcatatcagaattatctttagattcaactcttcatgccgtcaatcttcattgcaataacatctccaagatcgaagccattgatcatatttggaatttacaacatctagatctgtcatctaatcaaataagtagaattgaaggactaaacacactgacaaaactgtgcacattaaatttgtcctgcaatttgattacaaaagtagaaggacttgaagaactaattaatctgactagactaaatgtatcttataaccacatagatgatcttagtggattgattccccttcatggaattaagcataaacttagatatattgatctacatagtaatcgtatagatagtatccatcacttacttcagtgtatggtaggattgcacttcctgaccaatcttattttggagaaagatggagacgataatcctgtctgtcgactgccagggtacagagcagttattctccagactttgccacagcttagaatcctagattgcaagaacatatttggtgaaccagtaaatttgacagaaataaattcatcacagctgcagtgcctagaaggtcttttggataatttagtttcttctgattctcccctaaatataagtgaagatgagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaaacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaagttgtaatcgtaaaatgaaaccaccttaccttaaagaattatatgtaagctcatctttagcaaactgtcctatgttacaagaatcagaaaagccaaagactgaaataattaaagtagaccaaagtcactcagaagacaacacttaccagtcccttgttgaacagctagaccaagagagagagaagagatggagagctgagcaagccgaaaataaactcatggattatattgatgagctgcataaacatgcaaatgaaaaagaggatattcatagtctggctctacttaccacagataggctaaaggaaattatttttagagagagaaattccaaaggacaactcgaagttatggttcacaaacttcaaaatgaaattaaaaaactgactgttgaactaatgaaagcaaaagatcaacaagaggatcaccttaaacacttaagaaccctcgaaaaaacattagaaaaaatggagagacaaaaaaggcagcagcaggcagcacagataagactgatccaagaggtggaactcaaagcttcagctgccgatagagaaatatacttacttagaacttcccttcatcgagaaagagaacaagcgcaacaacttcatcaacttcttgcattgaaagaacaggaacacaggaaggaacttgaaacaagggagttttttactgatgctgacttccaggatgccttagctaaagaaatagccaaagaagagaaaaagcatgagcaaatgataaaagaataccaagagaaaattgacgtgttaagccagcagtatatggatttagaaaatgaattccgtattgctttaactgttgaagccagaagatttcaagatgttaaagatggttttgaaaatgttgcaactgagttagcaaagagcaaacatgctcttatttgggctcaacgaaaagaaaatgagtcttcctctttaattaaagatctgacctgtatggtaaaggaacaaaaaacaaaactggcagaagtttctaaattgaaacaagaaacagcagcaaatttacagaatcaaatcaacacccttgaaattttaattgaagatgacaagcagaagagtattcaaatagaacttctcaagcacgaaaaagtccagcttatttctgagctagcagccaaggaatcactaatatttggtttaaggacagaaagaaaagtatggggacatgagctggcacaacaaggatcttctctagcccaaaatcgtggaaaattggaggctcaaattgagagtttatctagagagaatgaatgtctgcgaaagacaaatgaaagtgatagtgatgcattaagaataaagtgcaaaatcatagacgaccaaactgaaactattagaaaattaaaagattgtttacaagaaaaagatgaacacatcaaaagattacaagaaaagatcacagaaatagaaaaatgcactcaagaacaacttgatgaaaaatcttcacaactggatgaggtacttgagaagttggaaaggcacaatgaaagaaaagaaaaactaaaacaacagttgaaaggaaaggaagtagaacttgaagaaatcagaaaagcttacagtacactgaatcggaagtggcatgataaaggagaacttctatgtcatcttgaaacacaagtaaaagaagtgaaagaaaaatttgaaaacaaggaaaagaaacttaaagcggaaagagacaaaagtattgaactacaaaagaatgcaatggaaaaacttcatagtatggatgatgcctttaaaagacaagttgatgcaattgttgaagctcatcaagctgaaatagcacagctggccaatgaaaagcagaagtgtattgattctgcaaatttaaaggtccatcaaattgaaaaagaaatgcgtgaacttttggaagaaacatgcaagaacaaaaaaacaatggaagcaaaaattaagcaacttgcttttgctttaaatgaaattcagcaagatatgtgatggttctgagaatgaatttaattgaaatagaccagcagacctattgtaaaaatgattaaatattgtaatagtagtaactgctatgactttgaaatgtctctttctatacatttcattatgaatatatttttaaagacttttgatcaagtatttattaattgtataggttttttataataaattgttgacaattttgtctattagaaaaaactatcataactagacttacaatatttttcttgtttctgtactatacattgtttggtaattacacatttgcctacaaatttgtgaatgaaaagattagtattttcaccatatgaggtaaaacattttaatcattgttatcttattgtgatgatgaagaactaattatatttgttatttaattgatgtagctcaattcttttaaagtacttatgtagccaaaaagcatttgaaatctgtatgataaaagatgtggcattcttaagaaagtatatgtagccatctccacatcactcattatgaccccttcttttataatgcttatatcttttcattaaagattacatttaaggtttta

SEQ ID NO: 147912 - DNA, 4493 bp, Homo sapiens
  Payload ID: 9262
  Gene Symbol: LRRCC1
  Gene Name: leucine rich repeat and coiled-coil centrosomal protein 1
  Uniprot ID: Q9C099
  ENST ID: ENST00000414626
  CDS Start-End: 890-3928
cccagatagtcacatttaaaggttgctagtttgaaatttgcaaatgcttccctgctgtcagagttaggtttcctacagctgtaagatagctgctactcaacctacagcagatgcccgtgacattgtgtgttcctgggtgtatctcccatctagcaactccaaactgtgtatgctgtagtttgtgttcctggaactactatcttcaggagaagcttcagttataaatagtaattggagtgaagagatgagttctgtttaggggagatccattaactttcaacaagggaggacagggactttttcaataggaattgcaataacatggtttgtttttgaaaatgcaatagactgtggattaaatagctattgcacacaaagaagaaaataaagttataatctccagcatgagatctggatttacatatgctctgttagctgcaagaatttgggcaagctatttaatttccataaatttaggtatccttaagatacccactgcttagagttattgtgagaattaattgaggtaagaaaactgaggctcaggttgtcatttgctcaaatcacacagcaaaaccgtgatagaatgcagattcaaactgggatattaacattccaaagcctttacagttattgactactattcagcactgccttcaatatatgctgatgactgcacacaggagttagaaatgcccactgtcacttgcctgccttgagcggtttcttgtttgtataaataatccaaaatacttggttgtgttgtaagaagcaccgtgttttgtgagacatttcaaaggtaccacaaataggaaagatttcattctagaatgaatagagcacatatttagtatctacgtgctgtttggttaattttagttatttggtcatgcttttaaaatctatttttatagtatatattttcttttatagcatatcagaattatctttagattcaactcttcatgccgtcaatcttcattgcaataacatctccaagatcgaagccattgatcatatttggaatttacaacatctagatctgtcatctaatcaaataagtagaattgaaggactaaacacactgacaaaactgtgcacattaaatttgtcctgcaatttgattacaaaagtagaaggacttgaagaactaattaatctgactagactaaatgtatcttataaccacatagatgatcttagtggattgattccccttcatggaattaagcataaacttagatatattgatctacatagtaatcgtatagatagtatccatcacttacttcagtgtatggtaggattgcacttcctgaccaatcttattttggagaaagatggagacgataatcctgtctgtcgactgccagggtacagagcagttattctccagactttgccacagcttagaatcctagattgcaagaacatatttggtgaaccagtaaatttgacagaaataaattcatcacagctgcagtgcctagaaggtcttttggataatttagtttcttctgattctcccctaaatataagtgaagatgagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaaacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaagttgtaatcgtaaaatgaaaccaccttaccttaaagaattatatgtaagctcatctttagcaaactgtcctatgttacaagaatcagaaaagccaaagactgaaataattaaagtagaccaaagtcactcagaagacaacacttaccagtcccttgttgaacagctagaccaagagagagagaagagatggagagctgagcaagccgaaaataaactcatggattatattgatgagctgcataaacatgcaaatgaaaaagaggatattcatagtctggctctacttaccacagataggctaaaggaaattatttttagagagagaaattccaaaggacaactcgaagttatggttcacaaacttcaaaatgaaattaaaaaactgactgttgaactaatgaaagcaaaagatcaacaagaggatcaccttaaacacttaagaaccctcgaaaaaacattagaaaaaatggagagacaaaaaaggcagcagcaggcagcacagataagactgatccaagaggtggaactcaaagcttcagctgccgatagagaaatatacttacttagaacttcccttcatcgagaaagagaacaagcgcaacaacttcatcaacttcttgcattgaaagaacaggaacacaggaaggaacttgaaacaagggagttttttactgatgctgacttccaggatgccttagctaaagaaatagccaaagaagagaaaaagcatgagcaaatgataaaagaataccaagagaaaattgacgtgttaagccagcagtatatggatttagaaaatgaattccgtattgctttaactgttgaagccagaagatttcaagatgttaaagatggttttgaaaatgttgcaactgagttagcaaagagcaaacatgctcttatttgggctcaacgaaaagaaaatgagtcttcctctttaattaaagatctgacctgtatggtaaaggaacaaaaaacaaaactggcagaagtttctaaattgaaacaagaaacagcagcaaatttacagaatcaaatcaacacccttgaaattttaattgaagatgacaagcagaagagtattcaaatagaacttctcaagcacgaaaaagtccagcttatttctgagctagcagccaaggaatcactaatatttggtttaaggacagaaagaaaagtatggggacatgagctggcacaacaaggatcttctctagcccaaaatcgtggaaaattggaggctcaaattgagagtttatctagagagaatgaatgtctgcgaaagacaaatgaaagtgatagtgatgcattaagaataaagtgcaaaatcatagacgaccaaactgaaactattagaaaattaaaagattgtttacaagaaaaagatgaacacatcaaaagattacaagaaaagatcacagaaatagaaaaatgcactcaagaacaacttgatgaaaaatcttcacaactggatgaggtacttgagaagttggaaaggcacaatgaaagaaaagaaaaactaaaacaacagttgaaaggaaaggaagtagaacttgaagaaatcagaaaagcttacagtacactgaatcggaagtggcatgataaaggagaacttctatgtcatcttgaaacacaagtaaaagaagtgaaagaaaaatttgaaaacaaggaaaagaaacttaaagcggaaagagacaaaagtattgaactacaaaagaatgcaatggaaaaacttcatagtatggatgatgcctttaaaagacaagttgatgcaattgttgaagctcatcaagctgaaatagcacagctggccaatgaaaagcagaagtgtattgattctgcaaatttaaaggtccatcaaattgaaaaagaaatgcgtgaacttttggaagaaacatgcaagaacaaaaaaacaatggaagcaaaaattaagcaacttgcttttgctttaaatgaaattcagcaagatatgtgatggttctgagaatgaatttaattgaaatagaccagcagacctattgtaaaaatgattaaatattgtaatagtagtaactgctatgactttgaaatgtctctttctatacatttcattatgaatatatttttaaagacttttgatcaagtatttattaattgtataggttttttataataaattgttgacaattttgtctattagaaaaaactatcataactagacttacaatatttttcttgtttctgtactatacattgtttggtaattacacatttgcctacaaatttgtgaatgaaaagattagtattttcaccatatgaggtaaaacattttaatcattgttatcttattgtgatgatgaagaactaattatatttgttatttaattgatgtagctcaattcttttaaagtacttatgtagccaaaaagcatttgaaatctgtatgataaaagatgtggcattcttaagaaagtatatgtagccatctccacatcactcattatgaccccttcttttataatgcttatatcttttcattaaagattacatttaaggtttta

SEQ ID NO: 147913 - DNA, 2800 bp, Homo sapiens
  Payload ID: 9262
  Gene Symbol: LRRCC1
  Gene Name: leucine rich repeat and coiled-coil centrosomal protein 1
  ENST ID: ENST00000522770
  CDS Start-End: 59-166
aagctcacggacccctcgctgggtgccggttaagaccccgctccccgtcgccagtgctatggaggcggcggcggcggtggtggcggcagaggcggaagtggaaaacgaagacggcgacagcagctgcggggatgtatgcttcatggacaaaggcttgcagaggtaaagggcgctccgcagccaggagcgacccgcgcactccccagagccggggccacgagtggctggcggcgacaccagagtggaggcgcggcactgctttaccaagaccataagtgaacgcagtctggctttcggcctccccgctcctccaaaacttacctgccgaagtgccaggttgaatgagccgtggatgccttcccgcccgtgtctcctgcccagcgtttcacacgactctgcttagcctagaaactgccccaggaccttgtcctccaccagcttctgaccactctttccttctgctggttttccttacttactggacttgaagaactaattaatctgactagactaaatgtatcttataaccacatagatgatcttagtggattgattccccttcatggaattaagcataaacttagatatattgatctacatagtaatcgtatagatagtatccatcacttacttcagtgtatggtaggattgcacttcctgaccaatcttattttggagaaagatggagacgataatcctgtctgtcgactgccagggtacagagcagttattctccagactttgccacagcttagaatcctagattgcaagaacatatttggtgaaccagtaaatttgacagaaataaattcatcacagctgcagtgcctagaaggtcttttggataatttagtttcttctgattctcccctaaatataagtgaagatgagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaaacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaagttgtaatcgtaaaatgaaaccaccttaccttaaagaattatatgtaagctcatctttagcaaactgtcctatgttacaagaatcagaaaagccaaagactgaaataattaaagtagaccaaagtcactcagaagacaacacttaccagtcccttgttgaacagctagaccaagagagagagaagagatggagagctgagcaagccgaaaataaactcatggattatattgatgagctgcataaacatgcaaatgaaaaagaggatattcatagtctggctctacttaccacagataggctaaaggaaattatttttagagagagaaattccaaaggacaactcgaagttatggttcacaaacttcaaaatgaaattaaaaaactgactgttgaactaatgaaagcaaaagatcaacaagaggatcaccttaaacacttaagaaccctcgaaaaaacattagaaaaaatggagagacaaaaaaggcagcagcaggcagcacagataagactgatccaagaggtggaactcaaagcttcagctgccgatagagaaatatacttacttagaacttcccttcatcgagaaagagaacaagcgcaacaacttcatcaacttcttgcattgaaagaacaggaacacaggaaggaacttgaaacaagggagttttttactgatgctgacttccaggatgccttagctaaagaaatagccaaagaagagaaaaagcatgagcaaatgataaaagaataccaagagaaaattgacgtgttaagccagcagtatatggatttagaaaatgaattccgtattgctttaactgttgaagccagaagatttcaagatgttaaagatggttttgaaaatgttgcaactgagttagcaaagagcaaacatgctcttatttgggctcaacgaaaagaaaatgagtcttcctctttaattaaagatctgacctgtatggtaaaggaacaaaaaacaaaactggcagaagtttctaaattgaaacaagaaacagcagcaaatttacagaatcaaatcaacacccttgaaattttaattgaagatgacaagcagaagagtattcaaatagaacttctcaagcacgaaaaagtccagcttatttctgagctagcagccaaggaatcactaatatttggtttaaggacagaaagaaaagtatggggacatgagctggcacaacaaggatcttctctagcccaaaatcgtggaaaattggaggctcaaattgagagtttatctagagagaatgaatgtctgcgaaagacaaatgaaagtgatagtgatgcattaagaataaagtgcaaaatcatagacgaccaaactgaaactattagaaaattaaaagattgtttacaagaaaaagatgaacacatcaaaagattacaagaaaagatcacagaaatagaaaaatgcactcaagaacaacttgatgaaaaatcttcacaactggatgaggtacttgagaagttggaaaggcacaatg

SEQ ID NO: 147914 - DNA, 2122 bp, Homo sapiens
  Payload ID: 9262
  Gene Symbol: LRRCC1
  Gene Name: leucine rich repeat and coiled-coil centrosomal protein 1
  ENST ID: ENST00000522567
  CDS Start-End: 82-192
cgcgcttccgggaggcttgtcccaagctcacggacccctcgctgggtgccggttaagaccccgctccccgtcgccagtgctatggaggcggcggcggcggtggtggcggcagaggcggaagtggaaaacgaagacggcgacagcagctgcggggatgtatgcttcatggacaaaggcttgcagaggacttgaagaactaattaatctgactagactaaatgtatcttataaccacatagatgatcttagtggattgattccccttcatggaattaagcataaacttagatatattgatctacatagtaatcgtatagatagtatccatcacttacttcagtgtatggtaggattgcacttcctgaccaatcttattttggagaaagatggagacgataatcctgtctgtcgactgccagacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaagttgtaatcgtaaaatgaaaccaccttaccttaaagaattatatgtaagctcatctttagcaaactgtcctatgttacaagaatcagaaaagccaaagactgaaataattaaagtagaccaaagtcactcagaagacaacacttaccagtcccttgttgaacagctagaccaagagagagagaagagatggagagctgagcaagccgaaaataaactcatggattatattgatgagctgcataaacatgcaaatgaaaaagaggatattcatagtctggctctacttaccacagataggctaaaggaaattatttttagagagagaaattccaaaggacaactcgaagttatggttcacaaacttcaaaatgaaattaaaaaactgactgttgaactaatgaaagcaaaagatcaacaagaggatcaccttaaacacttaagaaccctcgaaaaaacattagaaaaaatggagagacaaaaaaggcagcagcaggcagcacagataagactgatccaagaggtggaactcaaagcttcagctgccgatagagaaatatacttacttagaacttcccttcatcgagaaagagaacaagcgcaacaacttcatcaacttcttgcattgaaagaacaggaacacaggaaggaacttgaaacaagggagttttttactgatgctgacttccaggatgccttagctaaagaaatagccaaagaagagaaaaagcatgagcaaatgataaaagaataccaagagaaaattgacgtgttaagccagcagtatatggatttagaaaatgaattccgtattgctttaactgttgaagccagaagatttcaagatgttaaagatggttttgaaaatgttgcaactgagttagcaaagagcaaacatgctcttatttgggctcaacgaaaagaaaatgagtcttcctctttaattaaagatctgacctgtatggtaaaggaacaaaaaacaaaactggcagaagtttctaaattgaaacaagaaacagcagcaaatttacagaatcaaatcaacacccttgaaattttaattgaagatgacaagcagaagagtattcaaatagaacttctcaagcacgaaaaagtccagcttatttctgagctagcagccaaggaatcactaatatttggtttaaggacagaaagaaaagtatggggacatgagctggcacaacaaggatcttctctagcccaaaatcgtggaaaattggaggctcaaattgagagtttatctagagagaatgaatgtctgcgaaagacaaatgaaagtgatagtgatgcattaagaataaagtgcaaaatcatagacgaccaaactgaaactattagaaaattaaaagattgtttacaagaaaaagatgaacacatcaaaagattacaagaaaagatcacagaaatagaaaaatgcactcaagaacaacttgatgaaaaatcttcacaactggatgaggtacttgagaagttggaaaggcacaatgaaag

SEQ ID NO: 147915 - DNA, 1004 bp, Homo sapiens
  Payload ID: 9262
  Gene Symbol: LRRCC1
  Gene Name: leucine rich repeat and coiled-coil centrosomal protein 1
  ENST ID: ENST00000523669
  CDS Start-End: 59-169
aagctcacggacccctcgctgggtgccggttaagaccccgctccccgtcgccagtgctatggaggcggcggcggcggtggtggcggcagaggcggaagtggaaaacgaagacggcgacagcagctgcggggatgtatgcttcatggacaaaggcttgcagaggacttgaagaactaattaatctgactagactaaatgtatcttataaccacatagatgatcttagtggattgattccccttcatggaattaagcataaacttagatatattgatctacatagtaatcgtatagatagtatccatcacttacttcagtgtatggtaggattgcacttcctgaccaatcttattttggagaaagatggagacgataatcctgtctgtcgactgccagttgtaatcgtaaaatgaaaccaccttaccttaaagaattatatgtaagctcatctttagcaaactgtcctatgttacaagaatcagaaaagccaaagactgaaataattaaagtagaccaaagtcactcagaagacaacacttaccagtcccttgttgaacagctagaccaagagagagagaagagatggagagctgagcaagccgaaaataaactcatggattatattgatgagctgcataaacatgcaaatgaaaaagaggatattcatagtctggctctacttaccacagatagataagactgatccaagaggtggaactcaaagcttcagctgccgatagagaaatatacttacttagaacttcccttcatcgagaaagagaacaagcgcaacaacttcatcaacttcttgcattgaaagaacaggaacacaggaaggaacttgaaacaagggagttttttactgatgctgacttccaggatgccttagctaaagaaatagccaaagaagagaaaaagcatgagcaaatgataaaagaataccaagagaaaattgacgtgttaagccagcagtatatggatttagaaaatgaattccgtattgc

SEQ ID NO: 147916 - DNA, 2385 bp, Homo sapiens
  Payload ID: 9262
  Gene Symbol: LRRCC1
  Gene Name: leucine rich repeat and coiled-coil centrosomal protein 1
  ENST ID: ENST00000517875
  CDS Start-End: 59-169
aagctcacggacccctcgctgggtgccggttaagaccccgctccccgtcgccagtgctatggaggcggcggcggcggtggtggcggcagaggcggaagtggaaaacgaagacggcgacagcagctgcggggatgtatgcttcatggacaaaggcttgcagaggacttgaagaactaattaatctgactagactaaatgtatcttataaccacatagatgatcttagtggattgattccccttcatggaattaagcataaacttagatatattgatctacatagtaatcgtatagatagtatccatcacttacttcagtgtatggtaggattgcacttcctgaccaatcttattttggagaaagatggagacgataatcctgtctgtcgactgccagggtacagagcagttattctccagactttgccacagcttagaatcctagattgcaagaacatatttggtgaaccagtaaatttgacagaaataaattcatcacagctgcagtgcctagaaggtcttttggataatttagtttcttctgattctcccctaaatataagtgaagatgagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaaacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaagttgtaatcgtaaaatgaaaccaccttaccttaaagaattatatgtaagctcatctttagcaaactgtcctatgttacaagaatcagaaaagccaaagactgaaataattaaagtagaccaaagtcactcagaagacaacacttaccagtcccttgttgaacagctagaccaagagagagagaagagatggagagctgagcaagccgaaaataaactcatggattatattgatgagctgcataaacatgcaaatgaaaaagaggatattcatagtctggctctacttaccacagataggctaaaggaaattatttttagagagagaaattccaaaggacaactcgaagttatggttcacaaacttcaaaatgaaattaaaaaactgactgttgaactaatgaaagcaaaagatcaacaagaggatcaccttaaacacttaagaaccctcgaaaaaacattagaaaaaatggagagacaaaaaaggcagcagcaggcagcacagataagactgatccaagaggtggaactcaaagcttcagctgccgatagagaaatatacttacttagaacttcccttcatcgagaaagagaacaagcgcaacaacttcatcaacttcttgcattgaaagaacaggaacacaggaaggaacttgaaacaagggagttttttactgatgctgacttccaggatgccttagctaaagaaatagccaaagaagagaaaaagcatgagcaaatgataaaagaataccaagagaaaattgacgtgttaagccagcagtatatggatttagaaaatgaattccgtattgctttaactgttgaagccagaagatttcaagatgttaaagatggttttgaaaatgttgcaactgagttagcaaagagcaaacatgctcttatttgggctcaacgaaaagaaaatgagtcttcctctttaattaaagatctgacctgtatggtaaaggaacaaaaaacaaaactggcagaagtttctaaattgaaacaagaaacagcagcaaatttacagaatcaaatcaacacccttgaaattttaattgaagatgacaagcagaagagtattcaaatagaacttctcaagcacgaaaaagtccagcttatttctgagctagcagccaaggaatcactaatatttggtttaaggacagaaagaaaagtatggggacatgagctggcacaacaaggatcttctctagcccaaaatcgtggaaaattggaggctcaaattgagagtttatctagagagaatgaatgtctgcgaaagacaaatgaaagtgatagtgatgcattaagaataaagtgcaaaatcatagacgaccaaactgaaactattagaaaattaaaagattgtttacaagaaaaagatgaacacatcaaaagattacaag

SEQ ID NO: 147917 - DNA, 3381 bp, Homo sapiens
  Payload ID: 9263
  Gene Symbol: LRFN1
  Gene Name: leucine rich repeat and fibronectin type III domain containing 1
  Uniprot ID: Q9P244
  ENST ID: ENST00000248668
  CDS Start-End: 1-2316
atggctccaggacccttctcctcggccctcctctcgccgccgcccgctgccctgccctttctgctgctgctctgggcgggggcatctcgtggccagccctgccccggccgctgcatctgccagaacgtggcgcccacactgacaatgctgtgcgccaagaccggcttgctctttgtgccgcccgccatcgaccggcgcgtggtggagctgcggctcaccgacaacttcatcgccgccgtgcgccgccgagacttcgccaacatgaccagcctggtgcacctcactctctcccggaacaccatcggccaggtggcagctggcgccttcgccgacctgcgtgccctccgggccctgcacctggacagcaaccgcctggcggaggtgcgcggcgaccagctccgcggcctgggcaacctccgccacctgatccttggaaacaaccagatccgccgggtggagtcggcggcctttgacgccttcctgtccaccgtggaggacctggatctgtcctacaacaacctggaggccctgccgtgggaggcggtgggccagatggtgaacctaaacaccctcacgctggaccacaacctcatcgaccacatcgcggaggggaccttcgtgcagcttcacaagctggtccgtctggacatgacctccaaccgcctgcataaactcccgcccgacgggctcttcctgaggtcgcagggcaccgggcccaagccgcccaccccgctgaccgtcagcttcggcggcaaccccctgcactgcaactgcgagctgctctggctgcggcggctgacccgcgaggacgacttagagacctgcgccacgcccgaacacctcaccgaccgctacttctggtccatccccgaggaggagttcctgtgtgagcccccgctgatcacacggcaggcggggggccgggccctggtggtggaaggccaggcggtgagcctgcgctgccgagcggtgggtgaccccgagccggtggtgcactgggtggcacctgatgggcggctgctggggaactccagccggacccgggtccggggggacgggacgctggatgtgaccatcaccaccttgagggacagtggcaccttcacttgtatcgcctccaatgctgctggggaagcgacggcgcccgtggaggtgtgcgtggtacctctgcctctgatggcacccccgccggctgccccgccgcctctcaccgagcccggctcctctgacatcgccacgccgggcagaccaggtgccaacgattctgcggctgagcgtcggctcgtggcagccgagctcacctcgaactccgtgctcatccgctggccagcccagaggcctgtgcccggaatacgcatgtaccaggttcagtacaacagttccgttgatgactccctcgtctacaggatgatcccgtccaccagtcagaccttcctggtgaatgacctggcggcgggccgtgcctacgacttgtgcgtgctggcggtctacgacgacggggccacagcgctgccggcaacgcgagtggtgggctgtgtacagttcaccaccgctggggatccggcgccctgccgcccgctgagggcccatttcttgggcggcaccatgatcatcgccatcgggggcgtcatcgtcgcctcggtcctcgtcttcatcgttctgctcatgatccgctataaggtgtatggcgacggggacagccgccgcgtcaagggctccaggtcgctcccgcgggtcagccacgtgtgctcgcagaccaacggcgcaggcacaggcgcggcacaggccccggccctgccggcccaggaccactacgaggcgctgcgcgaggtggagtcccaggctgcccccgccgtcgccgtcgaggccaaggccatggaggccgagacggcatccgcggagccggaggtggtccttggacgttctctgggcggctcggccacctcgctgtgcctgctgccatccgaggaaacttccggggaggagtctcgggccgcggtgggccctcgaaggagccgatccggcgccctggagccaccaacctcggcgccccctactctagctctagttcctgggggagccgcggcccggccgaggccgcagcagcgctattcgttcgacggggactacggggcactattccagagccacagttacccgcgccgcgcccggcggacaaagcgccaccggtccacgccgcacctggacggggctggagggggcgcggccggggaggatggagacctggggctgggctccgccagggcgtgcctggctttcaccagcaccgagtggatgctggagagtaccgtgtgagcggcgggcgggcgccgggacgcctgggtgccgcagaccaaacgcccagccgcacggacgctggggcgggactgggagaaagcgcagcgccaagacattggaccagagtggagacgcgcccttgtccccgggagggggcggggcagcctcgggctgcggctcgaggccacgcccccgtgcccagggcggggttcggggaccggctgccggcctcccttcccctatggactcctcgacccccctcctacccctcccctcgcgcgctcgcggacctcgctggagccggtgccttacacagcgaagcgcggggaggggcagggccccctgacactgcagcactgagacacgagccccctcccccagcccgtcacccggggccggggcgaggggcccatttcttgtatctggctggactagatcctattctgtcccgcggcggcctccaaagcctcccaccccaccccacgcacattcctggtccggtcgggtctggcttggggtccccctttctctgtttccctcgtttgtctctatcccgccctcttgtcgtctctctgtagtgcctgtctttccctatttgcctctcctttctctctgtcctgtcgtctcttgtccctcggccctccctggttttgtctagtctccctgtctctcctgatttcttctctttactcattctcccgggcaggtcccactggaaggaccagactctcccaaataaatccccacacgaacaaaatccaaaaccaaatccccctccctaccggagccgggaccctccgccgcagcagaattaaacttttttctgtgtctgaggccctgctgacctgtgtgtgtgtctgtatgtgtgtccgcgtgtagtgtgtgtgtgtgtgtgtgtgtgtgtgtgtgtgtgtgtgtgttgggggagggtgacctagattgcagcataaggactctaagtgagactgaaggaagatgggaagatgactaactggggccggaggagactggcagacaggcttttatcctctgagagacttagaggtggggaataatcacaaaaataaaatgatcataatagct

SEQ ID NO: 147918 - DNA, 3270 bp, Homo sapiens
  Payload ID: 9264
  Gene Symbol: LRFN2
  Gene Name: leucine rich repeat and fibronectin type III domain containing 2
  Uniprot ID: Q9ULH4
  ENST ID: ENST00000338305
  CDS Start-End: 544-2913
tatgcgcgcgcgcgtggggggcagtgtgcatgcggggagtacgggggagtgtgtttgtgtgtgcgtgtgggtgtgagtgcctggctccctctcgctgagacacacatacactcacacatacacaacccggcaggctcgtctgaacttgaagacaccccacattccaagatgcccgaggttcctgggaatgcctggggttcttcgatccggaaaatcctaccggcatcctcctagggagggattattattattatttttctttaatctggaagagaagagaacaagttgtgcttttccccccttcttcttgctaaatgccatggatataactgaataagcggctcagggctttccccgcgtggacgtccgaggccaccatctgcctgcattcgccggagccgccggagggtttagctcgagtctgtctcgggcggggaaggatgcgtggccgagccggggagcccgggcgccccgcggagccggcctcggtgccacccagccgggggtagatgctgcctcgcccaggcgctgagtgaccagaccatggagaccctgcttggtggcctgctagcgtttggcatggcgtttgccgtggtcgacgcctgccccaagtactgtgtctgccagaatctgtctgagtcactggggaccctgtgcccctccaaggggctgctctttgtaccccctgatattgaccggcggacagtggagctgcgcctgggcggcaacttcatcatccacatcagccgccaggactttgccaacatgacggggctggtggacctgaccctgtccaggaacaccatcagccacatccagcccttttcctttctggacctcgagagcctccgctccctgcatcttgacagcaatcggctgccaagccttggggaggacaccctccggggcctggtcaacctgcagcaccttatcgtgaacaacaaccagctgggcggcatcgcagatgaggcttttgaggacttcctgctgacattggaggatctggacctctcctacaacaacctccatggcctgccgtgggactccgtgcgacgcatggtcaacctccaccagctgagcctggaccacaacctgctggatcacatcgccgagggcacctttgcagacctgcagaaactggcccgcctggatctcacctccaatcggctgcagaagctgccccctgatcccatctttgcccgctcccaggcttcggctttgacagccacaccctttgccccacccttgtcctttagttttgggggtaacccacttcactgcaattgtgagcttctctggctgcggaggctcgagcgggacgatgacctggaaacctgtggctccccagggggcctcaagggtcgctacttctggcatgtgcgtgaggaggagtttgtgtgcgagccgcctctcatcacccagcacacacacaagttgctggttctggagggccaggcggccacactcaagtgcaaagccattggggaccccagcccccttatccactgggtagcccccgatgaccgcctggtagggaactcctcaaggaccgctgtctatgacaatggcaccctggacatcttcatcaccacatctcaggacagtggtgccttcacctgcattgctgccaatgctgccggagaggccacggccatggtggaggtctccatcgtccagctgccacacctcagcaacagcaccagccgcactgcaccccccaagtcccgcctctcagacatcactggctccagcaagaccagccggggaggtggaggcagtgggggcggagagcctcccaaaagccccccggaacgggctgtgcttgtgtctgaagtgaccaccacctcggccctggtcaagtggtctgtcagcaagtcagcaccccgggtgaagatgtaccagctgcagtacaactgctctgacgatgaggtactgatttacaggatgatcccagcctccaacaaggccttcgtggtcaacaacctggtgtcagggactggctacgacttgtgtgtgctggccatgtgggatgacacagccacgacactcacggccaccaacatcgtgggctgcgcccagttcttcaccaaggctgactacccgcagtgccagtccatgcacagccagattctgggcggcaccatgatcctggtcatcgggggcatcatcgtggccacgctgctggtcttcatcgtcatcctcatggtgcgctacaaggtctgcaaccacgaggcccccagcaagatggcagcggccgtgagcaatgtgtactcgcagaccaacggcgcccagccaccgcctccaagcagcgcaccagccggggccccgccgcagggcccgccgaaggtggtggtgcgcaacgagctcctggacttcaccgccagcctggcccgcgccagtgactcctcttcctccagctccctgggcagtggggaggctgcggggctgggacgggccccctggaggatcccaccctccgccccgcgccccaagcccagccttgaccgcctgatgggggccttcgcctccctggacctcaagagtcagagaaaggaggagctgctggactccaggactccagccgggagaggggctgggacgtcggcccggggccaccactcggaccgagagccactgctggggccccctgcggcccgggccaggagcctgctccccttgccgttggagggcaaggccaaacgcagccactccttcgacatgggggactttgctgctgcggcggcgggaggggtcgtgccgggcggctacagtcctcctcggaaggtctcgaacatctggacgaagcgcagcctctctgtcaacggcatgctcttgccctttgaggagagtgacctggtgggggcccgggggacttttggcagctccgaatgggtgatggagagcacggtctaggtgggggtgggcatgctccctttcctgtgcgcagggtgggagaaggggaaagaatctcactggcaagtgtttgtggagtttccatggtgatgtttacatccagggacagtttcgtctccctgtcaatggcctcgtgtccccccctaccccgcaacacccacatcacctccccaccacccggccggggtgtgctcagggaatgtggactcgctcaaatgccggactgagccctgagtgtttggaaaggcgagactccgcctttctaatcacaaatgtagcctacaagcaagcggctttggattgcttatgggtctagtgttgtttttatttcttaatttattttttttccatttccca

SEQ ID NO: 147919 - DNA, 2513 bp, Homo sapiens
  Payload ID: 9265
  Gene Symbol: LRFN3
  Gene Name: leucine rich repeat and fibronectin type III domain containing 3
  Uniprot ID: Q9BTN0
  ENST ID: ENST00000246529
  CDS Start-End: 453-2339
ccaaggggcctgaacccgagtttgggcctgaagtccttgctgcagacctgagtgcttaaatctggggcttgagacctcccaatcttgactcagcaccccaatatctgaatgcagaaccccgggatcggatctcagactctaaaccccaccgtttggctgcttagcatcccaagactggacctgggagaccctgaccctgaacaacccaaactggacccgtaaaactggaccctagaggcccaatatttaggggtctggaaccccgagtattaaggtctggagactccgttgccacagatttgagccgagtcaggacacagtccctctacagaagccttggggacaggaaaagcatgaccagatgctccctccagagccctgacctctgactcccctggagctaggactctgctccctggggctgcttctagctcaggacacccctgcccgcgatggccatcctcccgttgctcctgtgcctgctgccgctggcccctgcctcatccccaccccagtcagccacacccagcccatgtccccgccgctgccgctgccagacacagtcgctgcccctaagcgtgctgtgcccaggggcaggcctcctgttcgtgccaccctcgctggaccgccgggcagccgagctgcggctggcagacaacttcatcgcctccgtgcgccgccgcgacctggccaacatgacaggcctgctgcatctgagcctgtcgcggaacaccatccgccacgtggctgccggcgccttcgccgacctgcgggccctgcgtgccctgcacctggatggcaaccggctgacctcactgggcgagggccagctgcgcggcctggtcaacttgcgccacctcatcctcagcaacaaccagctggcagcgctggcggccggcgccctggatgattgtgccgagacactggaggacctcgacctctcctacaacaacctcgagcagctgccctgggaggccctgggccgcctgggcaacgtcaacacgttgggcctcgaccacaacctgctggcttctgtgcccgccggcgctttttcccgcctgcacaagctggcccggctggacatgacctccaaccgcctgaccacaatcccacccgacccactcttctcccgcctgcccctgctcgccaggccccggggctcgcccgcctctgccctggtgctggcctttggcgggaaccccctgcactgcaactgcgagctggtgtggctgcgtcgcctggcgcgggaggacgacctcgaggcctgcgcgtccccacctgctctgggcggccgctacttctgggcggtgggcgaggaggagtttgtctgcgagccgcccgtggtgactcaccgctcaccacctctggctgtgcccgcaggtcggccggctgccctgcgctgccgggcagtgggggacccagagccccgtgtgcgttgggtgtcaccccagggccggctgctaggcaactcaagccgtgcccgcgccttccccaatgggacgctggagctgctggtcaccgagccgggtgatggtggcatcttcacctgcattgcggccaatgcagctggcgaggccacagctgctgtggagctgactgtgggtcccccaccacctcctcagctagccaacagcaccagctgtgaccccccgcgggacggggatcctgatgctctcaccccaccctccgctgcctctgcttctgccaaggtggccgacactgggccccctaccgaccgtggcgtccaggtgactgagcacggggccacagctgctcttgtccagtggccggatcagcggcctatcccgggcatccgcatgtaccagatccagtacaacagctcggctgatgacatcctcgtctacaggatgatcccggcggagagccgctcgttcctgctgacggacctggcgtcaggccggacctacgatctgtgcgtgctcgccgtgtatgaggacagcgccacggggctcacggccacgcggcctgtgggctgcgcccgcttctccaccgaacctgcgctgcggccatgcggggcgccgcacgctcccttcctgggcggcacgatgatcatcgcgctgggcggcgtcatcgtagcctcggtactggtcttcatcttcgtgctgctaatgcgctacaaggtgcacggcggccagccccccggcaaggccaagattcccgcgcctgttagcagcgtttgctcccagaccaacggcgccctgggccccacgcccacgcccgccccgcccgccccggagcccgcggcgctcagggcccacaccgtggtccagctggactgcgagccctgggggcccggccacgaacctgtgggaccctagccaggcgcccccccctctaagggtcctctggccccacggacagcaggacccggacaccctgtgggacctggcctcaaactcaccaaatcgctcatggtttttaaaactctgatggggagggtgtcggggacaccggggcaaaacaagaaagtcctatttttccaagcttgggcg

SEQ ID NO: 147920 - DNA, 3689 bp, Homo sapiens
  Payload ID: 9265
  Gene Symbol: LRFN3
  Gene Name: leucine rich repeat and fibronectin type III domain containing 3
  Uniprot ID: Q9BTN0
  ENST ID: ENST00000588831
  CDS Start-End: 1055-2941
ctccatgttggccaggctggtctccaacgcctgatctcaaaagatccgcccgccttggcctcccaacgagccgggattacaggcgtgagccaccgcccccggctgtcagtgtgtcttgaggtctttccctaatcccagatggcacaagttttccctcttgcaggcagagaaaggagccttgggaaggagcccctctggcctgaaagatcaagcctattgctgggcatggccagattgaatcgggaattccggaaacccgagcctggaaccctgatctgggaccagcaccccgagatccggccgtggaaccccaagatctggagcctgaaccccagtatatggggctggaatctcaacatcggtcactgggacctcaatatttggagccggaaccccacaatttggaacacagaccccaatatttggagcagaaccccaagatttgacatctaaaacctcaagcctggagctgaactctgaattctgggcctgggaccttgaaatctgggactggatttccagtactgtaccctggaacccactcttggggacctgaaccctgggattcaggcctcaaattccaagatctggactgtgggattccaaggggcctgaacccgagtttgggcctgaagtccttgctgcagacctgagtgcttaaatctggggcttgagacctcccaatcttgactcagcaccccaatatctgaatgcagaaccccgggatcggatctcagactctaaaccccaccgtttggctgcttagcatcccaagactggacctgggagaccctgaccctgaacaacccaaactggacccgtaaaactggaccctagaggcccaatatttaggggtctggaaccccgagtattaaggtctggagactccgttgccacagatttgagccgagtcaggacacagtccctctacagaagccttggggacaggaaaagcatgaccagatgctccctccagagccctgacctctgactcccctggagctaggactctgctccctggggctgcttctagctcaggacacccctgcccgcgatggccatcctcccgttgctcctgtgcctgctgccgctggcccctgcctcatccccaccccagtcagccacacccagcccatgtccccgccgctgccgctgccagacacagtcgctgcccctaagcgtgctgtgcccaggggcaggcctcctgttcgtgccaccctcgctggaccgccgggcagccgagctgcggctggcagacaacttcatcgcctccgtgcgccgccgcgacctggccaacatgacaggcctgctgcatctgagcctgtcgcggaacaccatccgccacgtggctgccggcgccttcgccgacctgcgggccctgcgtgccctgcacctggatggcaaccggctgacctcactgggcgagggccagctgcgcggcctggtcaacttgcgccacctcatcctcagcaacaaccagctggcagcgctggcggccggcgccctggatgattgtgccgagacactggaggacctcgacctctcctacaacaacctcgagcagctgccctgggaggccctgggccgcctgggcaacgtcaacacgttgggcctcgaccacaacctgctggcttctgtgcccgccggcgctttttcccgcctgcacaagctggcccggctggacatgacctccaaccgcctgaccacaatcccacccgacccactcttctcccgcctgcccctgctcgccaggccccggggctcgcccgcctctgccctggtgctggcctttggcgggaaccccctgcactgcaactgcgagctggtgtggctgcgtcgcctggcgcgggaggacgacctcgaggcctgcgcgtccccacctgctctgggcggccgctacttctgggcggtgggcgaggaggagtttgtctgcgagccgcccgtggtgactcaccgctcaccacctctggctgtgcccgcaggtcggccggctgccctgcgctgccgggcagtgggggacccagagccccgtgtgcgttgggtgtcaccccagggccggctgctaggcaactcaagccgtgcccgcgccttccccaatgggacgctggagctgctggtcaccgagccgggtgatggtggcatcttcacctgcattgcggccaatgcagctggcgaggccacagctgctgtggagctgactgtgggtcccccaccacctcctcagctagccaacagcaccagctgtgaccccccgcgggacggggatcctgatgctctcaccccaccctccgctgcctctgcttctgccaaggtggccgacactgggccccctaccgaccgtggcgtccaggtgactgagcacggggccacagctgctcttgtccagtggccggatcagcggcctatcccgggcatccgcatgtaccagatccagtacaacagctcggctgatgacatcctcgtctacaggatgatcccggcggagagccgctcgttcctgctgacggacctggcgtcaggccggacctacgatctgtgcgtgctcgccgtgtatgaggacagcgccacggggctcacggccacgcggcctgtgggctgcgcccgcttctccaccgaacctgcgctgcggccatgcggggcgccgcacgctcccttcctgggcggcacgatgatcatcgcgctgggcggcgtcatcgtagcctcggtactggtcttcatcttcgtgctgctaatgcgctacaaggtgcacggcggccagccccccggcaaggccaagattcccgcgcctgttagcagcgtttgctcccagaccaacggcgccctgggccccacgcccacgcccgccccgcccgccccggagcccgcggcgctcagggcccacaccgtggtccagctggactgcgagccctgggggcccggccacgaacctgtgggaccctagccaggcgcccccccctctaagggtcctctggccccacggacagcaggacccggacaccctgtgggacctggcctcaaactcaccaaatcgctcatggtttttaaaactctgatggggagggtgtcggggacaccggggcaaaacaagaaagtcctatttttccaagcttgggcgaagacccttgccctcgtctctgtctatgggggttgggggacggagcaggggtctggagctggggaatgcctcctttggggagacaccccctccccgcccagttcagtctgaggaccccggaggaggctgaggatggcgatccattcagacaatagatgttccctgcgtgtcggctctgagcatgccctgggttgggggatgctgtggtgatccagatagccctgagccctgcccgcaggggcctaaagtcaaatgggagacagacacatccccagacagtgatagcacagagtgaccagggatgtggggatgagggaagcctgggggattgtgacagtccagaagaggtacccttgctcagccccaggtgtggtcagggagggcttcctggaggaggacacatgtgatctgagaatgacatatgaaggagataactgggcaaagagcagaaggaaagctctttcaggcagagggcacagcacaagcaaggtggtggtgtgccctgggcactgggggtgctatggtagaggtgaggcaggagggttgagcagggtctaggacctccaggctgagg

SEQ ID NO: 147921 - DNA, 2431 bp, Homo sapiens
  Payload ID: 9266
  Gene Symbol: LRFN4
  Gene Name: leucine rich repeat and fibronectin type III domain containing 4
  Uniprot ID: Q6PJG9
  ENST ID: ENST00000309602
  CDS Start-End: 244-2151
cttgtccccagcgcctggactcccccttaactgcttgggaaatgtgacctttgctctggggggcctggccctgcaggccccaaccttccctcatctctggcggccctcttgggcctctgacccagcccctccccgggccaggctcacagaagctggcttctgggactgtcctgggcccaagtgggcacctgcgccagccccacctgtgcctgggctgtggccccttcctacagggcgctcaccatggccccgccgctcctgctgctgctgctggccagtggagcggccgcctgcccgctgccctgcgtctgccagaacctgtccgagtcgctcagcaccctctgtgcccaccgaggcctgctgtttgtgccgcccaacgtggaccggcgcacagtggagctgcggctggctgacaacttcatccaggccctggggccccctgacttccgcaacatgacgggactggtggacctgacactgtctcgcaatgccatcacccgcattggggcccgcgcctttggggacctcgagagcctgcgttccctccaccttgacggcaacaggctggtggagctgggcaccgggagcctccggggccccgtcaatctgcagcacctcatcctcagcggcaaccagctgggccgcatcgcgccgggagccttcgacgacttcctagagagcctggaggacctggacctgtcctacaacaacctccggcaggtgccctgggccggcatcggcgccatgcctgccctgcacaccctcaacctggaccataaccttattgacgcactgcccccaggcgccttcgcccagctcggtcagctctcccgcctggacctcacctccaaccgcctggccacgctggctccggacccgcttttctctcgtgggcgtgatgcagaggcctctcccgcccccctggtgctgagctttagcgggaaccccctgcactgcaactgtgagctgctgtggctgcggcggctggcgcggccggacgacctggaaacgtgcgcctccccgcccggcctggccggccgctacttctgggcagtgcccgagggcgagttctcctgtgagccgcccctcattgcccgccacacgcagcgcctctgggtgctggaaggccagcgggccacgctgcggtgccgggccctgggtgaccccgcgcctaccatgcactgggtcggtcctgacgaccggttggttggcaactcctcccgagcccgggctttccccaacgggaccttagagattggggtgaccggcgctggggacgctgggggctacacctgcatcgccaccaaccctgctggtgaggccacagcccgagtagaactgcgggtgctggccttgccccatggtgggaacagcagtgccgaggggggccgccccgggccctcggacatcgccgcctccgctcgcactgctgccgagggtgaggggacgctggagtctgagccagccgtgcaggtgacggaggtgaccgccacctcagggctggtgagctggggtcccgggcggccagccgacccagtgtggatgttccaaatccagtacaacagcagcgaagatgagaccctcatctaccggattgtcccagcctccagccaccacttcctgctgaagcacctcgtccccggcgctgactatgacctctgcctgctggccttgtcaccggccgctgggccctctgacctcacggccaccaggctgctgggctgtgcccatttctccacgctgccggcctcgcccctgtgccacgccctgcaggcccacgtgctgggcgggaccctgaccgtggccgtggggggtgtgctggtggctgccttactggtcttcactgtggccttgctggttcggggccggggggccggaaatggccgcctccccctcaagctcagccacgtccagtcccagaccaatggaggccccagccccacacccaaggcccacccgccgcggagccccccgccccggccgcagcgcagctgctctctggacctgggagatgccgggtgctacggttatgccaggcgcctgggaggagcttgggcccgacggagccactctgtgcatggggggctgctcggggcagggtgccggggggtaggaggcagcgccgagcggctggaagagagtgtggtgtgatggacgggcagcttcctgtgtgctccaagggatgagcctcgtggggcagagggcccggggccgccgcctggcctgggagtccctccctggtttttattctcagtacctcaggctcccctgtgtacttggaggggcagggagccctttcctcggttctggcctccagaccagggtaagggcaggcccctccaacaggtgctcacagccaccgaggcaggggctgcagccacccactgggagtcttgtttttatttataataaaattgttggggacacctca

SEQ ID NO: 147922 - DNA, 1550 bp, Homo sapiens
  Payload ID: 9266
  Gene Symbol: LRFN4
  Gene Name: leucine rich repeat and fibronectin type III domain containing 4
  ENST ID: ENST00000393952
  CDS Start-End: 190-1446
aaggtgccgggaaccgagcgagccggggccgcgggcccgagcgccatgggcccgagggtgggcggcgggcggccggtcatccccgggcctcgtccccgcgggagagcggccaggagtcggcgggggccggccgggctcgcagggaggccggcccgcgccccctgagcgacggacaccagggcgctcaccatggccccgccgctcctgctgctgctgctggccagtggagcggccgcctgcccgctgccctgcgtctgccagaacctgtccgagtcgctcagcaccctctgtgcccaccgaggcctgctgtttgtgccgcccaacgtggaccggcgcacagtggagctgcggctggctgacaacttcatccaggccctggggccccctgacttccgcaacatgacgggactggtggacctgacactgtctcgcaatgccatcacccgcattggggcccgcgcctttggggacctcgagagcctgcgttccctccaccttgacggcaacaggctggtggagctgggcaccgggagcctccggggccccgtcaatctgcagcacctcatcctcagcggcaaccagctgggccgcatcgcgccgggagccttcgacgacttcctagagagcctggaggacctggacctgtcctacaacaacctccggcaggtgccctgggccggcatcggcgccatgcctgccctgcacaccctcaacctggaccataaccttattgacgcactgcccccaggcgccttcgcccagctcggtcagctctcccgcctggacctcacctccaaccgcctggccacgctggctccggacccgcttttctctcgtgggcgtgatgcagaggcctctcccgcccccctggtgctgagctttagcgggaaccccctgcactgcaactgtgagctgctgtggctgcggcggctggcgcggccggacgacctggaaacgtgcgcctccccgcccggcctggccggccgctacttctgggcagtgcccgagggcgagttctcctgtgagccgcccctcattgcccgccacacgcagcgcctctgggtgctggaaggccagcgggccacgctgcggtgccgggccctgggtgaccccgcgcctaccatgcactgggtcggtcctgacgaccggttggttggcaactcctcccgagcccgggctttccccaacgggaccttagagattggggtgaccggcgctggggacgctgggggctacacctgcatcgccaccaaccctgctggtgaggccacagcccgagtagaactgcgggtgctggccttgccccatggtgggaacagcaggcccggggccgccgcctggcctgggagtccctccctggtttttattctcagtacctcaggctcccctgtgtacttggaggggcagggagccctttcctcggttctggcctccagaccagggtaagggcaggcccctccaacaggtgctcacagccaccgaggcaggggctgcagccacccactgggagtcttgtttttatttataataaaattgttggggacacctca

SEQ ID NO: 147923 - DNA, 3723 bp, Homo sapiens
  Payload ID: 9267
  Gene Symbol: LRFN5
  Gene Name: leucine rich repeat and fibronectin type III domain containing 5
  Uniprot ID: Q96NI6
  ENST ID: ENST00000298119
  CDS Start-End: 1190-3349
atttgactgtcttttatccaactgcccagaagcaaatgtgttaactcggcgatgccccttcatgcccgggttcttgcagagctctgaggacgcccagacccattttcctggctggatttggagcggctgctgggctgtggacccaggtgtgtggatcgctttacccagaagcttggaaagcgccaatattaacctgcttccaggtacatcacaaggtcaagagagtgtcttgcagccctcttgtttccgtgtatctacaccttcttctcttggccagaaggatatttacgttttggttcacagcatttgaagccaaaagttcagcccttcgaactggtttgctatacaaaacaaaacaaaacaaataaggtaatgaggattgcttattaaactgcttaacaaaatccccgactcttcctcagccctttctcggctccctcctccccaccaaaatgtcaccagctcttgaattacgtggattcgggttggaggagaacttgaaggaaacgtgattaaagggctatgcgagaacgctctctttgctgcccgcggtccggtgggcttcgaagccaatcgtgagaaggaccggttccctccgtgctgcttcctccccgtgcagtgctgggtgtgcgtgtgcgagtgtgagtgcaagtgcgcgcgcgcccgggtgcgagtgtgtgtgagtgtgagcgtgtgtctgtgtgtgcgtgcgcggccgccctgcctctgcccgctccccgggcgcggagccgcgggtttcatggggcgattgcagcgattcccccacccagagcgacctgcgggcagcggcggcagtggcaggagccgcctttccgattccctacgatgcgggtgctgagctatggcaaagggcagcgaagtgacgagcgagacccgcgtacgactgtgaaagccacctggagccaccttgccgggattgtacctgcaggcagaaagtcttcctacgaccgtcttttcccttagaggcaccagaatccctgtaaccattcatccaggtgttgagaagatatgtagcagccgagcacccatcttttgacaccgtcctctgaaatcagctttggagatgctttcactctgtccgtcttctgcagcagccaggcagagtgccgactccttcacagccgtgaggaactcttcaggctccagaagctcttaaacctgatctacaatggaaaaaattcttttttatctgtttctcattggcatagcagtgaaagctcagatctgtccaaagcgttgtgtctgtcagattttgtctcctaatcttgcaaccctttgtgccaagaaagggcttttatttgttccaccaaacattgacagaagaactgtggaactgcggttggcagacaattttgttacaaatattaaaaggaaagattttgccaatatgaccagcttggtggacctgactctatccaggaatacaataagttttattacacctcatgctttcgctgacctacgaaatttgagggctttgcatttgaatagcaacagattgactaaaattacaaatgatatgttcagtggtctttccaatcttcatcatttgatactgaacaacaatcagctgactttaatttcctctacagcgtttgatgatgtcttcgcccttgaggagctggatctgtcctataataatctagaaaccattccttgggatgctgttgagaagatggttagcttgcatacccttagtttggatcacaatatgattgataacattcctaaggggaccttctcccatttgcacaagatgactcggttagatgtgacatcaaataaattgcagaagctaccacctgaccctctctttcagcgagctcaggtactagcaacctcaggaatcataagcccatctacttttgcattaagttttggtggaaaccccttgcattgcaattgtgaattgttgtggttgaggcgtctgtccagagaagatgacttagagacctgtgcttctcctccacttttaactggccgctacttttggtcaattcctgaagaagagtttttgtgtgagcctcctctcattactcgtcatacacatgagatgagagtcctggagggacaaagggcaacactgaggtgcaaagccaggggagaccctgagcctgcaattcactggatttctcctgaagggaagcttatttcaaatgcaacaagatctctggtgtatgataacggaacacttgacattcttatcacaactgtaaaggatacaggtgcttttacctgcattgcttccaatcctgctggggaagcaacacaaatagtggatcttcatataattaagctccctcacttactaaatagtacaaaccatatccatgagcctgatcctggttcttcagatatctcaacttctaccaagtcaggttctaatacaagcagtagtaatggtgatactaaattgagtcaagataaaattgtggtggcagaagctacatcatcaacggcactacttaaatttaattttcaaagaaatatccctggaatacgtatgtttcaaatccagtacaatggtacttatgatgacacccttgtttacagaatgatacctcctacgagcaaaacttttctggtcaataatctggctgctggaactatgtatgacttgtgtgtcttggccatatatgatgatggcatcacttccctcactgccacaagagtcgtgggttgcatccagtttactacggaacaggattatgtgcgttgccatttcatgcagtctcagtttttgggaggcaccatgattattattattggtggaatcattgtagcatctgtgctggtattcatcattattctgatgatccggtataaggtttgcaacaataatgggcaacacaaggtcaccaaggttagcaatgtttattcccaaactaacggggctcaaatacaaggctgtagtgtaacgctgccccagtccgtgtccaaacaagctgtgggacacgaagagaatgcccagtgttgtaaagctaccagtgacaatgtgattcaatcttcagaaacttgttcgagtcaggactcctctaccactacctctgctttgcctccttcctggacttcaagcacttctgtgtcccaaaagcagaaaagaaagactggcacaaagccaagtacagaaccacagaatgaagccgtcacaaatgttgaatcccaaaacactaacaggaacaactcaactgccttgcagttagctagccgtcctcccgattctgtcacagaggggcccacgtctaaaagagcacatataaagccaaatgctttgctgactaatgttgaccagattgtccaggaaacacagaggctggagttaatctgaagagcaccacttctcctctctctcctgaaaaaatttgccactgatatttttactggataaaattcaaaaatgtttcaattcacaaaggctaattgttgaactggtgtcgtagaagaaattgtctacaggagccaaggtgaaagtctctgatgacggcggaactggctccattagaccatggttcatcctcttttaaaaccaaatttttttttcttctggcctacaagtattttttttttaaaaaagaaaaaaagcctacattggcatcaagttctgtatcaatccatcttacattgccatccatgatttaacagactgtagaatcttgaataatctatatcactttaacaaataaatgttttactatgacagaa

SEQ ID NO: 147924 - DNA, 4253 bp, Homo sapiens
  Payload ID: 9267
  Gene Symbol: LRFN5
  Gene Name: leucine rich repeat and fibronectin type III domain containing 5
  ENST ID: ENST00000554171
  CDS Start-End: 2433-3833
aacttcagtgagagatagaacaacatgttaaaggattatgtggaaggagttttgggggaggaattcctgaagttcataaagatgagactacttgaagaagaatttgattcctctctaaaaagattaatagaacttacgagcttaggaacttagaagttcagcaggactgttttatctgcagctgtctttggtcatagtcaatataaaactccacatgcttcacaaatgcgtttactcatctgtttatgtgacactaacactccgtggaagagattgttacaggagatagagttattgagtcaaccccagacactaatcaggaactgactccactttacatggagatatcatcaacagaacatttgaaagtgtaggtattcagggagcactgaaggaaatacaataacattagagttggaagtaaaccatgcagggagaaaaagaccattttttctctttcaaggatgaacaactaaaactggtcgaggaaagtgtgtcagagggctcctccatcttgagagaataggaggaggggatatctgccaagaatgagaaaaagaaatgaagatttacaactcaggaaaaaatgatcagtaaaacattacaaagccttttaaagcaacgtgaagatcttgtttgctactagaaacatgaatttgtggcgggcaaggtacatgttattgtgctgcagcccagggaaggtaatggagaagtaggtgattttgtgtagtgagggacttgtgaccactgttggtaatagcacagaacataattatggaggggcagtaagggttacatgataatagttgactattaatattaggagaagcgcaggtagctagaaaggaacaaatgagttgagtcaattagaaagaaatttagtttgaagtttttgatgaatgtaaagaggcaaaaatgaattactttgtgagacatgggggcaaaaaaatatctgaaactttgggtttgaaatatgctatgtgatgacaagttacaaggcatggttatatgaagcgtaaacgagtgatagagagtgaatatgatcatcaatagcatgaaggagagaagcttttccttttttaaaaacaggatgatatggggtttcacaatgtattattagaggtagtatagatgtctgcatgtgtaagacagaaaagaaaagagaagagaagaaaagaaaagaaaaacaaaacatgcaaaccggtttttgaacttgtcgagtagggagaaagtggatcctagctttgaggatttgaaaagagggatataatcataaaatcatagagtaataggtttgggaagaaacttagaactaatattgtacaatactataacttatagatgaggaagatcataaccaagagaggaaatttcttgtccagaaacagctatctcttagataatggttgggactagaatgcaaggtagttaacctcccttgttcttggtaacagtaaagatgatggctgtggtggtagtgattttgaacatagtggtgtaggcatacataccaagagcttattaaataagaaaacttcgttcctagctaatacaaaatggaaaggtaaattaatgtttggctttaatgctccctccaaaatgttagctctgtaaggacaggggtttttcatctcttatttcttggtaacatatctgattgagttaatactcattatatatttgcagaatacatgaataaacacacctttttaaaatttagaatatgttgatcaattagatgctattgtagaactatgagtctgctaaagggaatgttattttatgaagcatttatcactccaagtattcactaagtattgatggaccatcagaatacataacacttactcagctcataatatgaaccacatgctgtacatacattattttttagtcctcgtaataactcttgaaagtaattattataccaatggggacctaagcttgtatttaaactgtcaatttcttactgctagagctcagaccaaaaatatatagtgaacttattgggcagatgttacaaaagataatttgtgtgataaagtctctcttgggacagaatacctctttaaacaaagaagatgtcaggccgaagtgggttcatcacaaagcattaattgatttgatattttcaaagatatttgagctaaatttacatgataaggagttagctaggcaaagaagaggaattaggatattccaaattggtggtgcagatgcctcacatatccaaaagaatccctgtaaccattcatccaggtgttgagaagatatgtagcagccgagcacccatcttttgacaccgtcctctgaaatcagctttggagatgctttcactctgtccgtcttctgcagcagccaggcagagtgccgactccttcacagccgtgaggaactcttcaggctccagaagctcttaaacctgatctacaatggaaaaaattcttttttatctgtttctcattggcatagcagtgaaagctcagatctgtccaaagcgttgtgtctgtcagattttgtctcctaatcttgcaaccctttgtgccaagaaagggcttttatttgttccaccaaacattgacagaagaactgtggaactgcggttggcagacaattttgttacaaatattaaaaggaaagattttgccaatatgaccagcttggtggacctgactctatccaggaatacaataagttttattacacctcatgctttcgctgacctacgaaatttgagggctttgcatttgaatagcaacagattgactaaaattacaaatgatatgttcagtggtctttccaatcttcatcatttgatactgaacaacaatcagctgactttaatttcctctacagcgtttgatgatgtcttcgcccttgaggagctggatctgtcctataataatctagaaaccattccttgggatgctgttgagaagatggttagcttgcatacccttagtttggatcacaatatgattgataacattcctaaggggaccttctcccatttgcacaagatgactcggttagatgtgacatcaaataaattgcagaagctaccacctgaccctctctttcagcgagctcaggtactagcaacctcaggaatcataagcccatctacttttgcattaagttttggtggaaaccccttgcattgcaattgtgaattgttgtggttgaggcgtctgtccagagaagatgacttagagacctgtgcttctcctccacttttaactggccgctacttttggtcaattcctgaagaagagtttttgtgtgagcctcctctcattactcgtcatacacatgagatgagagtcctggagggacaaagggcaacactgaggtgcaaagccaggggagaccctgagcctgcaattcactggatttctcctgaagggaagcttatttcaaatgcaacaagatctctggtgtatgataacggaacacttgacattcttatcacaactgtaaaggatacaggtgcttttacctgcattgcttccaatcctgctggggaagcaacacaaatagtggatcttcatataattaagctccctcacttactaaatagtacaaaccatatccatgagcctgatcctggttcttcagatatctcaacttctaccaagtcaggttctaatacaagcagtagtaatggtgatactaaattgagtcaagataaaattgtggtggcagaagctacatcatcaacggcactacttaaatttaattttcaaagaaatatccctggaatacgtatgtttcaaatccagtacaatggtacttatgatgacacccttgtttacagatgctttgctgactaatgttgaccagattgtccaggaaacacagaggctggagttaatctgaagagcaccacttctcctctctctcctgaaaaaatttgccactgatatttttactggataaaattcaaaaatgtttcaattcacaaaggctaattgttgaactggtgtcgtagaagaaattgtctacaggagccaaggtgaaagtctctgatgacggcggaactggctccattagaccatggttcatcctcttttaaaaccaaatttttttttcttctggcctacaagtattttttttttaaaaaagaaaaaaagcctacattggcatcaagttctgtatcaatccatcttacattgccatccatgatttaacagactgtagaatcttgaataatctatatcactttaacaaataaatgttttactatgacagaa

SEQ ID NO: 147925 - DNA, 2121 bp, Homo sapiens
  Payload ID: 9267
  Gene Symbol: LRFN5
  Gene Name: leucine rich repeat and fibronectin type III domain containing 5
  ENST ID: ENST00000554120
  CDS Start-End: 345-1742
gatgcgggtgctgagctatggcaaagggcagcgaagtgacgagcgagacccgcgtacgactgtgaaagccacctggagccaccttgccgggattgtacctgcaggcagaaagtcttcctacgaccgtcttttcccttagaggcaccagaatccctgtaaccattcatccaggtgttgagaagatatgtagcagccgagcacccatcttttgacaccgtcctctgaaatcagctttggagatgctttcactctgtccgtcttctgcagcagccaggcagagtgccgactccttcacagccgtgaggaactcttcaggctccagaagctcttaaacctgatctacaatggaaaaaattcttttttatctgtttctcattggcatagcagtgaaagctcagatctgtccaaagcgttgtgtctgtcagattttgtctcctaatcttgcaaccctttgtgccaagaaagggcttttatttgttccaccaaacattgacagaagaactgtggaactgcggttggcagacaattttgttacaaatattaaaaggaaagattttgccaatatgaccagcttggtggacctgactctatccaggaatacaataagttttattacacctcatgctttcgctgacctacgaaatttgagggctttgcatttgaatagcaacagattgactaaaattacaaatgatatgttcagtggtctttccaatcttcatcatttgatactgaacaacaatcagctgactttaatttcctctacagcgtttgatgatgtcttcgcccttgaggagctggatctgtcctataataatctagaaaccattccttgggatgctgttgagaagatggttagcttgcatacccttagtttggatcacaatatgattgataacattcctaaggggaccttctcccatttgcacaagatgactcggttagatgtgacatcaaataaattgcagaagctaccacctgaccctctctttcagcgagctcaggtactagcaacctcaggaatcataagcccatctacttttgcattaagttttggtggaaaccccttgcattgcaattgtgaattgttgtggttgaggcgtctgtccagagaagatgacttagagacctgtgcttctcctccacttttaactggccgctacttttggtcaattcctgaagaagagtttttgtgtgagcctcctctcattactcgtcatacacatgagatgagagtcctggagggacaaagggcaacactgaggtgcaaagccaggggagaccctgagcctgcaattcactggatttctcctgaagggaagcttatttcaaatgcaacaagatctctggtgtatgataacggaacacttgacattcttatcacaactgtaaaggatacaggtgcttttacctgcattgcttccaatcctgctggggaagcaacacaaatagtggatcttcatataattaagctccctcacttactaaatagtacaaaccatatccatgagcctgatcctggttcttcagatatctcaacttctaccaagtcaggttctaatacaagcagtagtaatggtgatactaaattgagtcaagataaaattgtggtggcagaagctacatcatcaacggcactacttaaatttaattttcaaagaaatatccctggaatacgtatgtttcaaatccagtacaatggtacttatgatgacacccttgtttacagaggctggagttaatctgaagagcaccacttctcctctctctcctgaaaaaatttgccactgatatttttactggataaaattcaaaaatgtttcaattcacaaaggctaattgttgaactggtgtcgtagaagaaattgtctacaggagccaaggtgaaagtctctgatgacggcggaactggctccattagaccatggttcatcctcttttaaaaccaaatttttttttcttctggcctacaagtattttttttttaaaaaagaaaaaaagcctacattggcatcaagttctgtatcaatccatcttacattgccatccatgatttaacagactgtagaatcttgaataatctatatcactttaacaaataaatgttttactatgacagaa

SEQ ID NO: 147926 - DNA, 3055 bp, Homo sapiens
  Payload ID: 9268
  Gene Symbol: LINGO1
  Gene Name: leucine rich repeat and Ig domain containing 1
  Uniprot ID: Q96FE5
  ENST ID: ENST00000355300
  CDS Start-End: 176-2038
gcgcggggcggacagacggacagccagccccgcgagggcgcgcggactgccgggcggaggtgtcggaggaggaggaaacggaggagggggctgggcaggggctggggcctggtcgggccggctggagagacatgcgattggtgaccgagccgagcggaccgaaggcgcgcccgagatgcaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctagtctatctccgcttcctcaacctctcctacaaccccatcagcaccattgagggctccatgttgcatgagctgctccggctgcaggagatccagctggtgggcgggcagctggccgtggtggagccctatgccttccgcggcctcaactacctgcgcgtgctcaatgtctctggcaaccagctgaccacactggaggaatcagtcttccactcggtgggcaacctggagacactcatcctggactccaacccgctggcctgcgactgtcggctcctgtgggtgttccggcgccgctggcggctcaacttcaaccggcagcagcccacgtgcgccacgcccgagtttgtccagggcaaggagttcaaggacttccctgatgtgctactgcccaactacttcacctgccgccgcgcccgcatccgggaccgcaaggcccagcaggtgtttgtggacgagggccacacggtgcagtttgtgtgccgggccgatggcgacccgccgcccgccatcctctggctctcaccccgaaagcacctggtctcagccaagagcaatgggcggctcacagtcttccctgatggcacgctggaggtgcgctacgcccaggtacaggacaacggcacgtacctgtgcatcgcggccaacgcgggcggcaacgactccatgcccgcccacctgcatgtgcgcagctactcgcccgactggccccatcagcccaacaagaccttcgctttcatctccaaccagccgggcgagggagaggccaacagcacccgcgccactgtgcctttccccttcgacatcaagaccctcatcatcgccaccaccatgggcttcatctctttcctgggcgtcgtcctcttctgcctggtgctgctgtttctctggagccggggcaagggcaacacaaagcacaacatcgagatcgagtatgtgccccgaaagtcggacgcaggcatcagctccgccgacgcgccccgcaagttcaacatgaagatgatatgaggccggggcggggggcagggacccccgggcggccgggcaggggaaggggcctggccgccacctgctcactctccagtccttcccacctcctccctacccttctacacacgttctctttctccctcccgcctccgtcccctgctgccccccgccagccctcaccacctgccctccttctaccaggacctcagaagcccagacctggggaccccacctacacaggggcattgacagactggagttgaaagccgacgaaccgacacgcggcagagtcaataattcaataaaaaagttacgaactttctctgtaacttgggtttcaataattatggatttttatgaaaacttgaaataataaaaagagaaaaaaactatttcctatagctagtcggaatgcaaacttttgacgtcctgattgctccagggccctcttccaactcagtttcttgtttttctcttcctcctcctcctcttcttcctcctttctcttctcttccccagtggggagggatcactcaggaaaacaggaaaggaggttccagccccacccacctgcccaccccgccccaggcaccatcaggagcaggctagggggcaggcctgggcccagctccgggctggctttttgcagggcgcaggtggaggggacaggtctgccgatgggggtgggagcctgtctgctgggctgccaggcggcaccactgcaaggggtgggagcctggcttgggtgtggctgagactctggacagaggctggggtcctcctgggggacagcacagtcagtggagagagccaggggctggaggtggggcccaccccagcctctggtcccagctctgctgctcacttgctgtgtggcctcaagcaggtcactggcctctctgggcctcagtctccacatctgtacaaatgggaacattaccccctgccctgcctacctcacagggctgttgtgaggaattgatgagatgatgtatgtgaaacactttgtaacctgtaaagcgctgtgcacacgtg

SEQ ID NO: 147927 - DNA, 1035 bp, Homo sapiens
  Payload ID: 9268
  Gene Symbol: LINGO1
  Gene Name: leucine rich repeat and Ig domain containing 1
  ENST ID: ENST00000557798
  CDS Start-End: 58-1035
tccagacaggactgtccagagcaacggtgtgccagagagactgagaagtacccagaaatggtgcagctggaacagaaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctagtctatctccgcttcctcaacctctcctacaaccccatcagcaccattgagggctccatgttgcatgagctgctccggctgcaggagatccagctggtgggcggg

SEQ ID NO: 147928 - DNA, 2677 bp, Homo sapiens
  Payload ID: 9268
  Gene Symbol: LINGO1
  Gene Name: leucine rich repeat and Ig domain containing 1
  Uniprot ID: Q96FE5
  ENST ID: ENST00000561030
  CDS Start-End: 459-2303
agaggataattccccattatacagagatatttagcctaatagaagccgacagatcattcagggcagtaatgtactccggcttcaagcgtgtagtttcctcagcctgaactcccagattaaaggctccttgcccagcccgccctgtgccggtgcctgtgaccttgactgcaatgatgggggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgtttgcctcccaacgccatctgacccaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccgcgccttcagcggcctcaacagcctggagcagctgacgctggagaaatgcaacctgacctccatccccaccgaggcgctgtcccacctgcacggcctcatcgtcctgaggctccggcacctcaacatcaatgccatccgggactactccttcaagaggctgtaccgactcaaggtcttggagatctcccactggccctacttggacaccatgacacccaactgcctctacggcctcaacctgacgtccctgtccatcacacactgcaatctgaccgctgtgccctacctggccgtccgccacctagtctatctccgcttcctcaacctctcctacaaccccatcagcaccattgagggctccatgttgcatgagctgctccggctgcaggagatccagctggtgggcgggcagctggccgtggtggagccctatgccttccgcggcctcaactacctgcgcgtgctcaatgtctctggcaaccagctgaccacactggaggaatcagtcttccactcggtgggcaacctggagacactcatcctggactccaacccgctggcctgcgactgtcggctcctgtgggtgttccggcgccgctggcggctcaacttcaaccggcagcagcccacgtgcgccacgcccgagtttgtccagggcaaggagttcaaggacttccctgatgtgctactgcccaactacttcacctgccgccgcgcccgcatccgggaccgcaaggcccagcaggtgtttgtggacgagggccacacggtgcagtttgtgtgccgggccgatggcgacccgccgcccgccatcctctggctctcaccccgaaagcacctggtctcagccaagagcaatgggcggctcacagtcttccctgatggcacgctggaggtgcgctacgcccaggtacaggacaacggcacgtacctgtgcatcgcggccaacgcgggcggcaacgactccatgcccgcccacctgcatgtgcgcagctactcgcccgactggccccatcagcccaacaagaccttcgctttcatctccaaccagccgggcgagggagaggccaacagcacccgcgccactgtgcctttccccttcgacatcaagaccctcatcatcgccaccaccatgggcttcatctctttcctgggcgtcgtcctcttctgcctggtgctgctgtttctctggagccggggcaagggcaacacaaagcacaacatcgagatcgagtatgtgccccgaaagtcggacgcaggcatcagctccgccgacgcgccccgcaagttcaacatgaagatgatatgaggccggggcggggggcagggacccccgggcggccgggcaggggaaggggcctggccgccacctgctcactctccagtccttcccacctcctccctacccttctacacacgttctctttctccctcccgcctccgtcccctgctgccccccgccagccctcaccacctgccctccttctaccaggacctcagaagcccagacctggggaccccacctacacaggggcattgacagactggagttgaaagccgacgaaccgacacgcggcagagtcaataattcaataaaaaagttacgaactttctctgtaacttgggtttcaataattatggatttttatgaaaacttgaaataataaaaagagaaaaaaacta

SEQ ID NO: 147929 - DNA, 552 bp, Homo sapiens
  Payload ID: 9268
  Gene Symbol: LINGO1
  Gene Name: leucine rich repeat and Ig domain containing 1
  ENST ID: ENST00000559893
  CDS Start-End: 386-552
attattagctccatctaagagacaggaagacggagattccaagaggctcagggacttgcccggggtcacctggctgaccagtggccttgtcaggcctccacccagggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgtttgcctcccaacgccatctgacccaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctt

SEQ ID NO: 147930 - DNA, 522 bp, Homo sapiens
  Payload ID: 9268
  Gene Symbol: LINGO1
  Gene Name: leucine rich repeat and Ig domain containing 1
  ENST ID: ENST00000564472
  CDS Start-End: 416-522
actctgagatctaacccaaggaggagcgggtgcccgagaggggaagggagctcaagaaaaaaaaaaatagcttgcttgacttaattatgactgattgtgacagcttacatctttagtctgaaaagtatctatgggggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgtttgcctcccaacgccatctgacccaggtgagcaagaggatgctggcggggggcgtgaggagcatgcccagccccctcctggcctgctggcagcccatcctcctgctggtgctgggctcagtgctgtcaggctcggccacgggctg

SEQ ID NO: 147931 - DNA, 588 bp, Homo sapiens
  Payload ID: 9268
  Gene Symbol: LINGO1
  Gene Name: leucine rich repeat and Ig domain containing 1
  ENST ID: ENST00000567726
  CDS Start-End: 213-588
gattttaagctccatctcttgctggcggtgccaccttgggcaagccatgtggccattctgagctgttttctcatctgcagaatggttgggatcatttgtgcttcaagagtcatgtgcatgctgggaccgcgacggacaggctgccgcaccccaggcccccagaggccagtctgtttgcctcccaacgccatctgacccaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctga

SEQ ID NO: 147932 - DNA, 571 bp, Homo sapiens
  Payload ID: 9268
  Gene Symbol: LINGO1
  Gene Name: leucine rich repeat and Ig domain containing 1
  ENST ID: ENST00000570216
  CDS Start-End: 516-571
acctcgttccctggtttccctgatgaggcagttggaaggaggaggcagaccagtcctgcctccggcacccacaggccctgaggctccagtgcccacaggcagagagggcgactgagtccagcccaggctgagccctgcccagctgtactccccagacacccacccaacccgaggtgtcccaccgaggaggccctgatcttgagcccggagccctgagccctgagacgatgcttgaggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgtttgcctcccaacgccatctgacccaggtgagcaagaggatgctggcggggggcgtgaggagcatgcccagccccctcctggcctgctggcagcc

SEQ ID NO: 147933 - DNA, 611 bp, Homo sapiens
  Payload ID: 9268
  Gene Symbol: LINGO1
  Gene Name: leucine rich repeat and Ig domain containing 1
  ENST ID: ENST00000566711
  CDS Start-End: 396-611
gcacacgctgcgcgctctcacgcgcatacacacgccctccctgccgcgctcgccgccgcggccaccatcgcggagccgagccctgcggagcgggaaccgaggccggagcggggaccggaggcagccgagccgggggatgccggcccggagcggagccgcgcgcggacggcgcgcccgggacgcctccggcacccacaggccctgaggctccagtgcccacaggcagagagggcgactgagtccagcccaggctgagccctgcccagctgtactccccagacacccacccaacccgagtgcatgctgggaccgcgacggacaggctgccgcaccccaggcccccagaggccagtctgtttgcctcccaacgccatctgacccaggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggaccta

SEQ ID NO: 147934 - DNA, 938 bp, Homo sapiens
  Payload ID: 9268
  Gene Symbol: LINGO1
  Gene Name: leucine rich repeat and Ig domain containing 1
  ENST ID: ENST00000561686
  CDS Start-End: 403-938
ggctcagcctcaggtcctgcggggctgaccagtgtgcagagtgccctgaaagtgccaggcctggctgggtgcttcccatcttcacagcagctgagaggcagctaccaccacccttcttatagaagaggaagcagaggctttgtgaagtgtcccaccgaggaggccctgatcttgagcccggagccctgagccctgagacgatgcttgaggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcagggtgagcaagaggatgctggcggggggcgtgaggagcatgcccagccccctcctggcctgctggcagcccatcctcctgctggtgctgggctcagtgctgtcaggctcggccacgggctgcccgccccgctgcgagtgctccgcccaggaccgcgctgtgctgtgccaccgcaagcgctttgtggcagtccccgagggcatccccaccgagacgcgcctgctggacctaggcaagaaccgcatcaaaacgctcaaccaggacgagttcgccagcttcccgcacctggaggagctggagctcaacgagaacatcgtgagcgccgtggagcccggcgccttcaacaacctcttcaacctccggacgctgggtctccgcagcaaccgcctgaagctcatcccgctaggcgtcttcactggcctcagcaacctgaccaagctggacatcagcgagaacaagatcgttatcctactggactacatgtttcaggacctgtacaacctcaagtcactggaggttggcgacaatgacctcgtctacatctctcaccg

SEQ ID NO: 147935 - DNA, 567 bp, Homo sapiens
  Payload ID: 9268
  Gene Symbol: LINGO1
  Gene Name: leucine rich repeat and Ig domain containing 1
  ENST ID: ENST00000562933
  CDS Start-End: 533-567
gtgccaccgccccggactgttcccgcgcagcgaggtcccttccccggggcccccgggtggggccggtcgagccggcctccggcacccacaggccctgaggctccagtgcccacaggcagagagggcgactgagtccagcccaggctgagccctgcccagctgtactccccagacacccacccaacccgaggtgtcccaccgaggaggccctgatcttgagcccggagccctgagccctgagacgatgcttgaggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgtttgcctcccaacgccatctgacccaggtgagcaagaggatgctggcggggggcgtgaggagcatgcccagccc

SEQ ID NO: 147936 - DNA, 554 bp, Homo sapiens
  Payload ID: 9268
  Gene Symbol: LINGO1
  Gene Name: leucine rich repeat and Ig domain containing 1
  ENST ID: ENST00000563316
  CDS Start-End: 543-554
agttggaaggaggaggcagaccagtcctggtgagtgtccggggtggcaaggattgcagtctcagcggtggcctcagctctcacagcctccggcacccacaggccctgaggctccagtgcccacaggcagagagggcgactgagtccagcccaggctgagccctgcccagctgtactccccagacacccacccaacccgaggtgtcccaccgaggaggccctgatcttgagcccggagccctgagccctgagacgatgcttgaggatcttatgaccatgacctggctaccttgagtctgtggggctacacagccttcagcctgcatctccagggctctgactctatccagctcctggaccagctcccaagtctactcctgaccccagcctgggccaaggggacttctcaagctttgggacccagcaggacacagcagcagtcaggtgcatgctgggaccgcgacggacaggctgccgcaccccaggcccccagaggccagtctgtttgcctcccaacgccatctgacccaggtgagcaagaggatgctggcgggg

SEQ ID NO: 147937 - DNA, 3031 bp, Homo sapiens
  Payload ID: 9269
  Gene Symbol: LINGO2
  Gene Name: leucine rich repeat and Ig domain containing 2
  Uniprot ID: Q7L985
  ENST ID: ENST00000308675
  CDS Start-End: 446-2266
tgtaggaattgatgagtgccatcagaaagctgtatcatgagctgcctgcacttctaaagtgtccagtggatttttaatcacatgagcctggaaatagggttatgagaagaagctcagagcagagcaccgaaagtggccactaccagcatgaagagcccaacaattcaaactggtaagtgagtctcatcttgtttgttgcaggttcgtttcaagcagttggcttgtgggactctgagagatgctgctgcccatgacatgcgggaattatcatgatcaactacccagcttggatttcacccagtggccaagagctttgtgtgggagacggcaagggttggatttttcaaagattttctcaggataaatcatgaggaacctataacccttttggccacatgcaaaaaagcaagacccgtgaccaaggtgtagactaagaagtggagtcatgcttcacacggccatatcatgctggcagccattcctgggtctggctgtggtgttaatcttcatgggatccaccattggctgccccgctcgctgtgagtgctctgcccagaacaaatctgttagctgtcacagaaggcgattgatcgccatcccagagggcattcccatcgaaaccaaaatcttggacctcagtaaaaacaggctaaaaagcgtcaaccctgaagaattcatatcatatcctctgctggaagagatagacttgagtgacaacatcattgccaatgtggaaccaggagcattcaacaatctctttaacctgcgttccctccgcctaaaaggcaatcgtctaaagctggtccctttgggagtattcacggggctgtccaatctcactaagcttgacattagtgagaataagattgtcattttactagactacatgttccaagatctacataacctgaagtctctagaagtgggggacaatgatttggtttatatatcacacagggcattcagtgggcttcttagcttggagcagctcaccctggagaaatgcaacttaacagcagtaccaacagaagccctctcccacctccgcagcctcatcagcctgcatctgaagcatctcaatatcaacaatatgcctgtgtatgcctttaaaagattgttccacctgaaacacctagagattgactattggcctttactggatatgatgcctgccaatagcctctacggtctcaacctcacatccctttcagtcaccaacaccaatctgtctactgtacccttccttgcctttaaacacctggtatacctgactcaccttaacctctcctacaatcccatcagcactattgaagcaggcatgttctctgacctgatccgccttcaggagcttcatatagtgggggcccagcttcgcaccattgagcctcactccttccaagggctccgcttcctacgcgtgctcaatgtgtctcagaacctgctggaaactttggaagagaatgtcttctcctcccctagggctctggaggtcttgagcattaacaacaaccctctggcctgtgactgccgccttctctggatcttgcagcgacagcccaccctgcagtttggtggccagcaacctatgtgtgctggcccagacaccatccgtgagaggtctttcaaggatttccatagcactgccctttctttttactttacctgcaaaaaacccaaaatccgtgaaaagaagttgcagcatctgctagtagatgaagggcagacagtccagctagaatgcagtgcagatggagacccgcagcctgtgatttcctgggtgacaccccgaaggcgtttcatcaccaccaagtccaatggaagagccaccgtgttgggtgatggcaccttggaaatccgctttgcccaggatcaagacagcgggatgtatgtttgcatcgctagcaatgctgctgggaatgataccttcacagcctccttaactgtgaaaggattcgcttcagatcgttttctttatgcgaacaggacccctatgtacatgaccgactccaatgacaccatttccaatggcaccaatgccaatactttttccctggaccttaaaacaatactggtgtctacagctatgggctgcttcacattcctgggagtggttttattttgttttcttctcctttttgtgtggagccgagggaaaggcaagcacaaaaacagcattgaccttgagtatgtgcccagaaaaaacaatggtgctgttgtggaaggggaggtagctggacccaggaggttcaacatgaaaatgatttgaaggcccacccctcacattactgtctctttgtcaatgtgggtaatcagtaagacagtatggcacagtaaattactagattaagaggcagccatgtgcagctgcccctgtatcaaaagcagggtctatggaagcaggaggacttccaatggagactctccatcgaaaggcaggcaggcaggcatgtgtcagagcccttcacacagtgggatactaagtgtttgcgttgcaaatattggcgttctggggatctcagtaatgaacctgaatatttggctcacactcacggacaattattcagcattttctaccactgcaaaaaacaaaagaaaaaataaaaaagaacaacctacagtgtaggatttacatattaaaaagacacatttgtctaaaacatactctacagaaaaatttgtatctatgattatcatttgttaaagccttgcatcataccatattgttggttcagtaccacaaagagatcaatatattcttttcttccttttttgaaacatatatgctgtacatgttttaaagcaatatgaatgagaggttgtgcttttagttactcaccactatagatccaagtgtgatttcaccttccgttacctacagatgaccctgagactagatccctggagttatgggcggagatattttgagagatgtgtttgtctgatgtaggatgccaagaaacaggacccaaggcaaaactgctcaactctgttaacttctgttactataaataaaggcatgtgcctagttttg

SEQ ID NO: 147938 - DNA, 3044 bp, Homo sapiens
  Payload ID: 9269
  Gene Symbol: LINGO2
  Gene Name: leucine rich repeat and Ig domain containing 2
  Uniprot ID: Q7L985
  ENST ID: ENST00000379992
  CDS Start-End: 451-2271
tgtaggaattgatgagtgccatcagaaagctgtatcatgagctgcctgcacttctaaagtgtccagtggatttttaatcacatgagcctggaaatagggttatgagaagaagctcagagcagagcaccgaaagtggccactaccagcatgaagagcccaacaattcaaactggtgaagtgagaaaaacagaatgcagctttcaaggttcgtttcaagcagttggcttgtgggactctgagagatgctgctgcccatgacatgcgggaattatcatgatcaactacccagcttggatttcacccagtggccaagagctttgtgtgggagacggcaagggttggatttttcaaaagagtaaaccaggataaatcatgaggaacctataacccttttggccacatgcaaaaaagcaagacccgtgaccaaggtgtagactaagaagtggagtcatgcttcacacggccatatcatgctggcagccattcctgggtctggctgtggtgttaatcttcatgggatccaccattggctgccccgctcgctgtgagtgctctgcccagaacaaatctgttagctgtcacagaaggcgattgatcgccatcccagagggcattcccatcgaaaccaaaatcttggacctcagtaaaaacaggctaaaaagcgtcaaccctgaagaattcatatcatatcctctgctggaagagatagacttgagtgacaacatcattgccaatgtggaaccaggagcattcaacaatctctttaacctgcgttccctccgcctaaaaggcaatcgtctaaagctggtccctttgggagtattcacggggctgtccaatctcactaagcttgacattagtgagaataagattgtcattttactagactacatgttccaagatctacataacctgaagtctctagaagtgggggacaatgatttggtttatatatcacacagggcattcagtgggcttcttagcttggagcagctcaccctggagaaatgcaacttaacagcagtaccaacagaagccctctcccacctccgcagcctcatcagcctgcatctgaagcatctcaatatcaacaatatgcctgtgtatgcctttaaaagattgttccacctgaaacacctagagattgactattggcctttactggatatgatgcctgccaatagcctctacggtctcaacctcacatccctttcagtcaccaacaccaatctgtctactgtacccttccttgcctttaaacacctggtatacctgactcaccttaacctctcctacaatcccatcagcactattgaagcaggcatgttctctgacctgatccgccttcaggagcttcatatagtgggggcccagcttcgcaccattgagcctcactccttccaagggctccgcttcctacgcgtgctcaatgtgtctcagaacctgctggaaactttggaagagaatgtcttctcctcccctagggctctggaggtcttgagcattaacaacaaccctctggcctgtgactgccgccttctctggatcttgcagcgacagcccaccctgcagtttggtggccagcaacctatgtgtgctggcccagacaccatccgtgagaggtctttcaaggatttccatagcactgccctttctttttactttacctgcaaaaaacccaaaatccgtgaaaagaagttgcagcatctgctagtagatgaagggcagacagtccagctagaatgcagtgcagatggagacccgcagcctgtgatttcctgggtgacaccccgaaggcgtttcatcaccaccaagtccaatggaagagccaccgtgttgggtgatggcaccttggaaatccgctttgcccaggatcaagacagcgggatgtatgtttgcatcgctagcaatgctgctgggaatgataccttcacagcctccttaactgtgaaaggattcgcttcagatcgttttctttatgcgaacaggacccctatgtacatgaccgactccaatgacaccatttccaatggcaccaatgccaatactttttccctggaccttaaaacaatactggtgtctacagctatgggctgcttcacattcctgggagtggttttattttgttttcttctcctttttgtgtggagccgagggaaaggcaagcacaaaaacagcattgaccttgagtatgtgcccagaaaaaacaatggtgctgttgtggaaggggaggtagctggacccaggaggttcaacatgaaaatgatttgaaggcccacccctcacattactgtctctttgtcaatgtgggtaatcagtaagacagtatggcacagtaaattactagattaagaggcagccatgtgcagctgcccctgtatcaaaagcagggtctatggaagcaggaggacttccaatggagactctccatcgaaaggcaggcaggcaggcatgtgtcagagcccttcacacagtgggatactaagtgtttgcgttgcaaatattggcgttctggggatctcagtaatgaacctgaatatttggctcacactcacggacaattattcagcattttctaccactgcaaaaaacaaaagaaaaaataaaaaagaacaacctacagtgtaggatttacatattaaaaagacacatttgtctaaaacatactctacagaaaaatttgtatctatgattatcatttgttaaagccttgcatcataccatattgttggttcagtaccacaaagagatcaatatattcttttcttccttttttgaaacatatatgctgtacatgttttaaagcaatatgaatgagaggttgtgcttttagttactcaccactatagatccaagtgtgatttcaccttccgttacctacagatgaccctgagactagatccctggagttatgggcggagatattttgagagatgtgtttgtctgatgtaggatgccaagaaacaggacccaaggcaaaactgctcaactctgttaacttctgttactataaataaaggcatgtgcctagttttgatacagaa

SEQ ID NO: 147939 - DNA, 2981 bp, Homo sapiens
  Payload ID: 9269
  Gene Symbol: LINGO2
  Gene Name: leucine rich repeat and Ig domain containing 2
  Uniprot ID: Q7L985
  ENST ID: ENST00000613945
  CDS Start-End: 396-2216
ttgtaggaattgatgagtgccatcagaaagctgtatcatgagctgcctgcacttctaaagtgtccagtggatttttaatcacatgagcctggaaatagggttatgagaagaagctcagagcagagcaccgaaagtggccactaccagcatgaagagcccaacaattcaaactggtaagtgagtctcatcttgtttgttgcaggttcgtttcaagcagttggcttgtgggactctgagagatgctgctgcccatgacatgcgggaattatcatgatcaactacccagcttggatttcacccagtggccaagagctttgtgtgggagacggcaagggttggatttttcaaagattcatgcagacccgtgaccaaggtgtagactaagaagtggagtcatgcttcacacggccatatcatgctggcagccattcctgggtctggctgtggtgttaatcttcatgggatccaccattggctgccccgctcgctgtgagtgctctgcccagaacaaatctgttagctgtcacagaaggcgattgatcgccatcccagagggcattcccatcgaaaccaaaatcttggacctcagtaaaaacaggctaaaaagcgtcaaccctgaagaattcatatcatatcctctgctggaagagatagacttgagtgacaacatcattgccaatgtggaaccaggagcattcaacaatctctttaacctgcgttccctccgcctaaaaggcaatcgtctaaagctggtccctttgggagtattcacggggctgtccaatctcactaagcttgacattagtgagaataagattgtcattttactagactacatgttccaagatctacataacctgaagtctctagaagtgggggacaatgatttggtttatatatcacacagggcattcagtgggcttcttagcttggagcagctcaccctggagaaatgcaacttaacagcagtaccaacagaagccctctcccacctccgcagcctcatcagcctgcatctgaagcatctcaatatcaacaatatgcctgtgtatgcctttaaaagattgttccacctgaaacacctagagattgactattggcctttactggatatgatgcctgccaatagcctctacggtctcaacctcacatccctttcagtcaccaacaccaatctgtctactgtacccttccttgcctttaaacacctggtatacctgactcaccttaacctctcctacaatcccatcagcactattgaagcaggcatgttctctgacctgatccgccttcaggagcttcatatagtgggggcccagcttcgcaccattgagcctcactccttccaagggctccgcttcctacgcgtgctcaatgtgtctcagaacctgctggaaactttggaagagaatgtcttctcctcccctagggctctggaggtcttgagcattaacaacaaccctctggcctgtgactgccgccttctctggatcttgcagcgacagcccaccctgcagtttggtggccagcaacctatgtgtgctggcccagacaccatccgtgagaggtctttcaaggatttccatagcactgccctttctttttactttacctgcaaaaaacccaaaatccgtgaaaagaagttgcagcatctgctagtagatgaagggcagacagtccagctagaatgcagtgcagatggagacccgcagcctgtgatttcctgggtgacaccccgaaggcgtttcatcaccaccaagtccaatggaagagccaccgtgttgggtgatggcaccttggaaatccgctttgcccaggatcaagacagcgggatgtatgtttgcatcgctagcaatgctgctgggaatgataccttcacagcctccttaactgtgaaaggattcgcttcagatcgttttctttatgcgaacaggacccctatgtacatgaccgactccaatgacaccatttccaatggcaccaatgccaatactttttccctggaccttaaaacaatactggtgtctacagctatgggctgcttcacattcctgggagtggttttattttgttttcttctcctttttgtgtggagccgagggaaaggcaagcacaaaaacagcattgaccttgagtatgtgcccagaaaaaacaatggtgctgttgtggaaggggaggtagctggacccaggaggttcaacatgaaaatgatttgaaggcccacccctcacattactgtctctttgtcaatgtgggtaatcagtaagacagtatggcacagtaaattactagattaagaggcagccatgtgcagctgcccctgtatcaaaagcagggtctatggaagcaggaggacttccaatggagactctccatcgaaaggcaggcaggcaggcatgtgtcagagcccttcacacagtgggatactaagtgtttgcgttgcaaatattggcgttctggggatctcagtaatgaacctgaatatttggctcacactcacggacaattattcagcattttctaccactgcaaaaaacaaaagaaaaaataaaaaagaacaacctacagtgtaggatttacatattaaaaagacacatttgtctaaaacatactctacagaaaaatttgtatctatgattatcatttgttaaagccttgcatcataccatattgttggttcagtaccacaaagagatcaatatattcttttcttccttttttgaaacatatatgctgtacatgttttaaagcaatatgaatgagaggttgtgcttttagttactcaccactatagatccaagtgtgatttcaccttccgttacctacagatgaccctgagactagatccctggagttatgggcggagatattttgagagatgtgtttgtctgatgtaggatgccaagaaacaggacccaaggcaaaactgctcaactctgttaacttctgttactataaataaaggcatgtgcctagttttg

SEQ ID NO: 147940 - DNA, 2241 bp, Homo sapiens
  Payload ID: 9270
  Gene Symbol: LINGO3
  Gene Name: leucine rich repeat and Ig domain containing 3
  Uniprot ID: P0C6S8
  ENST ID: ENST00000585527
  CDS Start-End: 249-2027
gtagagatgggagtcttgctatgttgtgcaggctggtctcgaactcttgaactcaagcaattcttccatctcagcctcccaaaatgctgggtttacaggagcgagccgccgtgctgggacgggttaggggcgggctggcggcagaggcgccgcggaggggtgctaacggtgctaacgctgcccgctccccgcccgcccgcaggtgcgcaggaggatggtggcgcggccctaggcccacgctccgcaccatgacctgctggctgtgcgtcctgagcctgcccctgctcctgctgcccgcggcgccgcccccggctggaggctgcccggcccgctgcgagtgcaccgtgcagacccgcgcggtggcctgcacgcgccgccgcctgaccgccgtgcccgacggcatcccggccgagacccgcctgctggagctcagccgcaaccgcatccgctgcctgaacccgggcgacctggccgcgctgcccgcgctggaggagctggacctgagcgagaacgccatcgcgcacgtggagcccggcgccttcgccaacctgccgcgcctgcgcgtcctgcgtctccgtggcaaccagctgaagctcatcccgcccggggtcttcacgcgcctggacaacctcacgctgctggacctgagcgagaacaagctggtaatcctgctggactacactttccaggacctgcacagcctgcgccggctggaagtgggcgacaacgacctggtattcgtctcgcgccgcgccttcgcggggctgctggccctggaggagctgaccctggagcgctgcaacctcacggctctgtccggggagtcgctgggccatctgcgcagcctgggcgccctgcggctgcgccacctggccatcgcctccctggaggaccagaacttccgcaggctgcccgggctgctgcacctggagattgacaactggccgctgctggaggaggtggcggcgggcagcctgcggggcctgaacctgacctcgctgtcggtcacccacaccaacatcaccgccgtgccggccgccgcgctgcggcaccaggcgcacctcacctgcctcaatctgtcgcacaaccccatcagcacggtgccgcgggggtcgttccgggacctggtccgcctgcgcgagctgcacctggccggggccctgctggctgtggtggagccgcaggccttcctgggcctgcgccagatccgcctgctcaacctctccaacaacctgctctccacgttggaggagagcaccttccactcggtgaacacgctagagacgctgcgcgtggacgggaacccgctggcctgcgactgtcgcctgctgtggatcgtgcagcgtcgcaagaccctcaacttcgacgggcggctgccggcctgcgccaccccggccgaggtgcgcggcgacgcgctgcgaaacctgccggactccgtgctgttcgagtacttcgtgtgccgcaaacccaagatccgggagcggcggctgcagcgcgtcacggccaccgcgggcgaagacgtccgcttcctctgccgcgccgagggcgagccggcgcccaccgtggcctgggtgaccccccagcaccggccggtgacggccaccagcgcgggccgggcgcgcgtgctccccggggggacgctggagatccaggacgcgcggccgcaggacagcggcacctacacgtgcgtggccagcaacgcgggcggcaacgacacctacttcgccacgctgaccgtgcgccccgagccggccgccaaccggaccccgggcgaggcccacaacgagacgctggcggccctgcgcgcgccgctcgacctcaccaccatcctggtgtccaccgccatgggctgcatcaccttcctgggcgtggtcctcttctgcttcgtgctgctgttcgtgtggagccgcggccgcgggcagcacaaaaacaacttctcggtggagtactccttccgcaaggtggatgggccggccgccgcggcgggccagggaggcgcgcgcaagttcaacatgaagatgatctgaggggtccccagggcggaccctcccctcccctcccccgcgggccggccgctcgcgtgtccacctatgcatttcccggaggggaaggggacggctgcacggcgctccccaggcagaacttcccctttttttgtagacgcccaaccgcaggactgtttttcatcagcatgcgtcttttttgcagtttctcaagcgttttctaaagatttcaacccgt

SEQ ID NO: 147941 - DNA, 3379 bp, Homo sapiens
  Payload ID: 9271
  Gene Symbol: LINGO4
  Gene Name: leucine rich repeat and Ig domain containing 4
  Uniprot ID: Q6UY18
  ENST ID: ENST00000368820
  CDS Start-End: 939-2720
ttgtgtcctctaaggggacgggttcatctgagtaaacataaaccccaacttgtgccattctttataaaatgattttaaaggcaagaagtgtgtgtgtcagagggtgggggagattcttaaattagattacctgcatgcctgctctccagtctcattcctgggtcaagactcaggtttccagctcagcaatccatcagcattatacagatccaacccaccctcacccgacccctgcagtttctccccaggtggagcagtccctcagtgaggactgtgaacgaatcttcaggaacccccactgtaggagcctcaaactgagccccacgggagatgctctagactgagaacttcccataaatgatacccacggggaacgtttagatttagaggttgcacagaattgctccacatctgggagaccaaaagacagtcctctggaaggtggctggcccaagctccccagtgggggaatcaggatgtcagagagatcctctagaacctgctgttcttgctattgcatgacccctccctggcaccagagcctccctcctggctccctcccctgtcacttgccagcctgtagtggtgcttgctgcagccctccctggttgctttatttatttattttgcaccaacagggttgctgcagactcattcttgcctggtttaaaaagagagagagagagagaggaaaaaaaaaaaggagaaatgctttctggctcttttctccacctcagtcttggcagcagcggccgcagcagcaacagcagcagcagcagcggcaggcagcagccgggcagccaggcagcgggggttgaggcacacagggaaggtgcaggggcctgaggtgcagctcgaatgggacagggcccccagcgctggacagatgcagtgccaaacttgatgccaccttccagcttctccggactgaagagggaatggatgcagccacagctccaaagcaagcctggcccccatggcccccgctccttttcctcctcctcctacctggagggagcggtggcagctgccctgctgtgtgtgactgcacctcccagccccaggctgtgctctgtggccacaggcaactggaggctgtacctggaggactcccactggacactgagctcctggacctgagtgggaaccgcctgtgggggctccagcagggaatgctctcccgcctgagcctgctccaggaattggacctcagctacaaccagctctcaacccttgagcctggggccttccatggcctacaaagcctactcaccctgaggctgcagggcaatcggctcagaatcatggggcctggggtcttctcaggcctctctgctctgaccctgctggacctccgcctcaaccagattgttctcttcctagatggagcttttggggagctaggcagcctccagaagctggaggttggggacaaccacctggtatttgtggctccgggggcctttgcagggctagccaagttgagcaccctcaccctggagcgctgcaacctcagcacagtgcctggcctagcccttgcccgtctcccggcactagtggccctaaggcttagagaactggatattgggaggctgccagctggggccctgcgggggctggggcagctcaaggagctggagatccacctctggccatctctggaggctctggaccctgggagcctggttgggctcaatctcagcagcctggccatcactcgctgcaatctgagctcggtgcccttccaagcactgtaccacctcagcttcctcagggtcctggatctgtcccagaatcccatctcagccatcccagcccgaaggctcagccccctggtgcggctccaggagctacgcctgtcaggggcatgcctcacctccattgctgcccatgccttccatggcttgactgccttccacctcctggatgtggcagataacgcccttcagacactagaggaaacagctttcccttctccagacaaactggtcaccttgaggctgtctggcaaccccctaacctgtgactgccgcctcctctggctgctccggctccgccgccacctggactttggcatgtccccccctgcctgtgctggcccccatcatgtccaggggaagagcctgaaggagttttcagacatcctgcctccagggcacttcacctgcaaaccagccctgatccgaaagtcggggcctcgatgggtcattgcagaggagggcgggcatgcggttttctcctgctctggagatggagacccagcccccactgtctcctggatgaggcctcatggggcttggctgggcagggctgggagagtaagggtcctagaggatgggacactggagatccgctcagtgcagctacgggacagaggggcctatgtctgtgtggttagcaatgtcgctgggaatgactccctgaggacctggctggaagtcatccaggtggaaccaccaaacggcacactttctgaccccaacatcaccgtgccagggatcccagggcctttttttctggatagcagaggtgtggccatggtgctggcagtcggcttcctccccttcctcacctcagtgaccctctgctttggcctgattgccctttggagcaagggcaaaggtcgggtcaaacatcacatgacctttgactttgtggcacctcggccctctggggataaaaactctgggggtaaccgggtcactgccaagctcttctgacctttccttccccagtggggaacccaccaagtccgcttcagataccaaaggggaagacagaaccaaggctgcttgaaccagaacctagtcccgagcagcaccgctctcctgcacctcccgcctgcgttgtgcctcctgccggagagtctgcttcctgagcttttccggtctgaggatagcattgtcatttcttctctgagggtcccagggagctgcagatgcagaccccgtcgttagtccagcccctgcttcaccccctccacacacaaaacaggaaacataatcaaagcgctagtcagctagtctaaccactaggctttcttcacacatgcttatatcctttaataaccaattgccaaccacggctataagattatttcagaggtggggctgggaagtgccacttgctccttagagtctgtttgtcaaccaggcagagtccctttcttttctgctccccaccccaaccctgcccctatgtacaggaataagagcaaaggacccacaggctacagagaagaggatggggacagagtgtgggatggagaggacagaccatatactgcactgtgtttgcatgagcctctaccaccttcctctatctaccagatcattaaacctgctgtcaaagggccacaacagtagcagccaaaactaaa

SEQ ID NO: 147942 - DNA, 3146 bp, Homo sapiens
  Payload ID: 9272
  Gene Symbol: LRSAM1
  Gene Name: leucine rich repeat and sterile alpha motif containing 1
  Uniprot ID: Q6UWE0
  ENST ID: ENST00000300417
  CDS Start-End: 373-2544
agagacgcccttgtcgccatgtttgttgtgggcaggcgcctgaggctgacggctggcaagcagggcaccgcggtgcgctgaagctagagattccgaaagggggttcgggtagttcgctccggagaagtctgagaagggtggctccggtgatcccagccctagctgtttcccatattcctttatccacctgcctttgaaggagaccagactccggctccgcccggcccgtgccgggtggtctgcggccccgagtccgtgaccaagccctccgagtgatcggcctgccctcgggtgcacccgcgggtcccaacgtgggggatccctccatccgcaaagccagggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcaacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcatccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccagattaagttaatagaaactgagttattgcagctgacacagctggagttaaagaggaagtccctggacacagagtcactccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctgcagagctggaggtgcaggcctcagagtgtgtcgtgtgcctggaacgggaggcccagatgatcttcctcaactgtggccacgtctgctgctgccagcagtgctgccagccactgcgcacctgcccgctgtgccgccaggacatcgcccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcgct

SEQ ID NO: 147943 - DNA, 3376 bp, Homo sapiens
  Payload ID: 9272
  Gene Symbol: LRSAM1
  Gene Name: leucine rich repeat and sterile alpha motif containing 1
  Uniprot ID: Q6UWE0
  ENST ID: ENST00000323301
  CDS Start-End: 605-2776
gtgggcaggcgcctgaggctgacggctggcaagcagggcaccgcggtgcgctgaagctagagattccgaaagggggttcgggtagttcgctccggagaagtctgagaagggtggctccggtgatcccagccctagctgtttcccatattcctttatcgtgagtgtcaccccggtccccgtcacccaatcccagagccccgcccctcccctgaggggtccgtagtcccattccgagaccccagtaccgcggcgacccctgctccctcgagcacttgttgtgtgcactttagttatcaaaacagtctatgtggaaatccagtcccgctcttcattcggagagtccgcgattcctagagcctcagacttcgtcatcccggtctgcgtgactttatgagattctgagtttctgttcccagcacctgcctttgaaggagaccagactccggctccgcccggcccgtgccgggtggtctgcggccccgagtccgtgaccaagccctccgagtgatcggcctgccctcgggtgcacccgcgggtcccaacgtgggggatccctccatccgcaaagccagggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcaacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcatccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccagattaagttaatagaaactgagttattgcagctgacacagctggagttaaagaggaagtccctggacacagagtcactccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctgcagagctggaggtgcaggcctcagagtgtgtcgtgtgcctggaacgggaggcccagatgatcttcctcaactgtggccacgtctgctgctgccagcagtgctgccagccactgcgcacctgcccgctgtgccgccaggacatcgcccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcg

SEQ ID NO: 147944 - DNA, 2849 bp, Homo sapiens
  Payload ID: 9272
  Gene Symbol: LRSAM1
  Gene Name: leucine rich repeat and sterile alpha motif containing 1
  Uniprot ID: Q6UWE0
  ENST ID: ENST00000373322
  CDS Start-End: 78-2249
atcaggaagggggtgcaagagggttagtgattggggagcagaaggggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcaacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcatccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccagattaagttaatagaaactgagttattgcagctgacacagctggagttaaagaggaagtccctggacacagagtcactccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctgcagagctggaggtgcaggcctcagagtgtgtcgtgtgcctggaacgggaggcccagatgatcttcctcaactgtggccacgtctgctgctgccagcagtgctgccagccactgcgcacctgcccgctgtgccgccaggacatcgcccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcg

SEQ ID NO: 147945 - DNA, 3044 bp, Homo sapiens
  Payload ID: 9272
  Gene Symbol: LRSAM1
  Gene Name: leucine rich repeat and sterile alpha motif containing 1
  Uniprot ID: Q6UWE0
  ENST ID: ENST00000373324
  CDS Start-End: 354-2444
tgtttgttgtgggcaggcgcctgaggctgacggctggcaagcagggcaccgcggtgcgctgaagctagagattccgaaagggggttcgggtagttcgctccggagaagtctgagaagggtggctccggtgatcccagccctagctgtttcccatattcctttatccacctgcctttgaaggagaccagactccggctccgcccggcccgtgccgggtggtctgcggccccgagtccgtgaccaagccctccgagtgatcggcctgccctcgggtgcacccgcgggtcccaacgtgggggatccctccatccgcaaagccagggtcctaaagatcgctctgggaaaagggaaggatgccgctcttcttccggaagcggaaacccagtgaggaggctcggaaacgcctggagtaccagatgtgtttggcaaaagaagctggggcagatgacattctcgacatctctaaatgtgagctctcagagattccatttggagcttttgcaacatgcaaagttctgcagaagaaggtgctgatcgtccacacgaatcacctcacttccctgcttcccaaatcctgcagcctcctgagtctggcaaccatcaaggttctagatctccacgataatcagctgacagcccttcctgacgatctggggcagctgactgccctccaggtcttaaacgtggaaaggaatcaactgatgcagctcccacgttccattgggaacctgacccagctccagactctcaatgttaaagacaacaagctgaaggagcttccagacaccgtgggggagcttcgaagcctgcgtaccctcaacatcagtggaaacgagatccagagattgccgcagatgctggctcacgttcgaaccctggagatgctgagccttgacgcctcggccatggtctacccgccgcgggaggtgtgtggtgccggcactgcggccatcttgcagttcctctgcaaagagtcagggctggaatactaccccccttctcagtacttgctgccaattctggagcaagatggaatcgagaactctcgggacagccctgatgggcccacggacagattctcaagggaggagttagagtggcagaacaggttctcagactatgagaagaggaaggaacagaagatgctggagaaactcgagtttgaacggcgcctggaactggggcagcgggagcacacccagctccttcagcagagcagcagccagaaggatgagatccttcagacggtcaaggaggagcagtcccggctggagcagggcctgagtgagcaccagcgccacctcaacgcagagcggcagcggctgcaggagcagctgaagcagacggaacagaacatttccagccggatccagaagctgctgcaggacaatcagagacaaaagaaaagctccgagattttgaaatcgctggaaaatgaaagaataagaatggaacagttgatgtccataacccaggaggagactgagagcctgcggcgacgtgacgttgcctccgccatgcagcagatgctgactgagagctgtaagaaccggctcatccagatggcctacgaatctcagaggcagaacttggtccagcaggcctgttccagcatggccgaaatggatgaacgattccagcagattctgtcgtggcagcaaatggatcagaacaaagccatcagccagatcctgcaggagagcgcgatgcagaaggctgcgttcgaggcactccaggtgaagaaagacctgatgcatcggcagatcaggagccaggagatgatctcggagcagcgctgggccctcagctccctgctccagcagctgctcaaagagaagcagcagcgagaggaagagctccgggaaatcctgacggagttagaagccaaaagtgaaaccaggcaggaaaattactggctgattcagtatcaacggcttttgaaccagaagcccttgtccttgaagctgcaagaagaggggatggagcgccagctggtggccctcctggaggagctgtcggctgagcactacctgcccatctttgcgcaccaccgcctctcactggacctgctgagccaaatgagcccaggggacctggccaaggtgggcgtctcagaagctggcctgcagcacgagatcctccggagagtccaggaactgctggatgcagccaggatccagccagagctgaaaccaccaatgggtgaggtcgtcacccctacggccccccaggagcctcctgagtctgtgaggccatccgctccccctgcagagctggaggtgcaggcctcagagtgtgtcgtgtgcctggaacgggaggcccagatgatcttcctcaactgtggccacgtctgctgctgccagcagtgctgccagccactgcgcacctgcccgctgtgccgccaggacatcgcccagcgcctccgcatctaccacagcagctgagtgctgcccgcccacctgggcctggtcctagccctgcctcggccactgtgagccccgggctcctgctcagccttgtgccagccagactcgtatgaggctcccccctgccctgggccccttccccactgcccaggagcccccatcctaagctccaagcatgtctgggccaggcagaggtgctcctcatccatgacaccaccagtctgaatggtcctgggggctggggctggagaggccgctgcaccaccacccgagcctgggagccagcgtcccagcctaatcacggatctgctgcctcccagctgtcttgactgaaggccaccgcccctgcaggagcttgggtcctcatctgggggccatgcacaggcccgtcccaccctgcatgtgggaagggagcaggagggcctggctgggtgaggggaggccttcctgggaaggcgtgtggtgcaggcctgtgctcacagtggcaccagcaaccctgggtctccctctctgctgctccccagaaccccggggccctcctgctctccacaactgtccctccttaccccatgtagctcgatccgaagcaggagtgtcaataaacctgtcttcagtgcg

SEQ ID NO: 147946 - DNA, 808 bp, Homo sapiens
  Payload ID: 9273
  Gene Symbol: LRRC1
  Gene Name: leucine rich repeat containing 1
  ENST ID: ENST00000370882
  CDS Start-End: 168-632
ccttgaagcacttccgaccgcgaagcccggcgcgagaagcgagctaacccaagagccaacaacgagcgcggagagggcagcggactgagcggagccgccggccagagcgggctcggagcccgggtctccgccgctcgggacccggctaggcggcggcgggggcggcgatgttccactgcatccccctgtggcggtgcaaccgtcatgtggagagcatcgacaagcgccactgctcgctggtctacgtccccgaggagatctaccgctatgcccggagcctggaggagctgctgctggacgccaaccagctccgcgagctgcccgagcaatttttccagctagtcaaattacgaaagcttggacttagtgataatgaaattcagcggctccctccagaaatagcaaacttcatgcagctggtggaactagatgtgtctcgaaatgagattcctgaaattccagaaagcatttcattctgtaaagcactgcaggtagctgacttcagcggaaacccactgactaggttgccagaaagctttcctgaattacagaatttaacatgtctttctgtaaatgacatctcactacagtctctacctgaaaatattggcaagcagaagacaactagctgacacctgttcagccagcaagttggtgtttttctgaaatgtacactgatgttttatctttatgccattagacttgctaattaaaaattctgcccttaaactctcaggaggagaagaagacaggaagccctcaatacactctaggtgtatggtatcagttgcagagaaaacagtggtat

SEQ ID NO: 147947 - DNA, 3180 bp, Homo sapiens
  Payload ID: 9273
  Gene Symbol: LRRC1
  Gene Name: leucine rich repeat containing 1
  Uniprot ID: Q9BTT6
  ENST ID: ENST00000370888
  CDS Start-End: 278-1852
ggaagctccgcgcggcggcgggggcggcgacggcgactggcgggtgggagtggaggcaccggctggcgggcgggggtacagggacggggcaggggctcccgctccaggttccttgaagcacttccgaccgcgaagcccggcgcgagaagcgagctaacccaagagccaacaacgagcgcggagagggcagcggactgagcggagccgccggccagagcgggctcggagcccgggtctccgccgctcgggacccggctaggcggcggcgggggcggcgatgttccactgcatccccctgtggcggtgcaaccgtcatgtggagagcatcgacaagcgccactgctcgctggtctacgtccccgaggagatctaccgctatgcccggagcctggaggagctgctgctggacgccaaccagctccgcgagctgcccgagcaatttttccagctagtcaaattacgaaagcttggacttagtgataatgaaattcagcggctccctccagaaatagcaaacttcatgcagctggtggaactagatgtgtctcgaaatgagattcctgaaattccagaaagcatttcattctgtaaagcactgcaggtagctgacttcagcggaaacccactgactaggttgccagaaagctttcctgaattacagaatttaacatgtctttctgtaaatgacatctcactacagtctctacctgaaaatattggcaatctttataacctggcttcactggaactgagagagaatcttcttacatatcttcctgactctcttacccagctgcgaagactagaagaacttgatttaggaaacaatgaaatatataatttgccagaatcaattggagccctcttacatctaaaagatctctggttggatggaaatcaactgtcagaattacctcaggaaataggaaatctgaagaacctgctgtgtttagatgtctctgaaaacaggttggaaagacttcctgaagaaatcagtggcctgacttcattaacggatttagtcatttcccagaacttattagaaacgattccggatggcattggaaaactaaagaaactgtcaatcttgaaggtggatcagaatagactcacacagttgcctgaagcagttggggaatgtgaaagtctcactgagttagttcttacagaaaatcagctcctgaccctgcctaaaagcattggaaaactaaagaagttgagcaacttgaatgcagacagaaataaattagtgtccttaccaaaagagatcggcgggtgctgcagcctcactgtgttctgtgtacgtgacaacagactaactcggatacctgcagaggtgtcacaggcaacagaacttcatgtcctggatgtggcagggaacaggttgctgcatctacctttatccctgactgccttgaagttgaaggctctgtggctatctgacaaccagtcccagcccctgcttacattccagacagacacagactacaccacaggagagaagattttaacctgtgtcttacttcctcagctgccttctgaacctacttgtcaagagaatctgcctcgctgtggtgcactggagaacttggtaaatgatgtctctgatgaagcctggaacgagcgtgctgtcaacagagtcagtgcgatccgatttgtggaggatgagaaagatgaagaagacaatgagacgagaacacttctaaggcgagccactccacacccaggggagttaaagcacatgaaaaagacagtggagaatttacggaatgacatgaatgctgctaaaggactggactcaaacaaaaacgaggtcaatcatgccattgaccgagtgaccacttctgtgtagagtttcacctccaagttttacctcctgtgtcttcctctgctgtcgagacgttcctgtctgcttcccgggagcctcacgtgctccttgtcctaaccagcccccgcgcgccatcttcccgtggagtgtggggaagctgctgtctcccaggaagtgccttactcatcccgcaaccagtcagcgcaccagtggtctcccggtgtgattttttttttttttaatttcagttgtttgtaataagtagaatacactactgtaaacatacgacctttgtttttgtcttatgttggggtaaaggaaagcaggaaggggaatttttatcctcctcccttccgtaaagtgctgggatattttgaatcccccaagttcccttggacctactgatgagagatagttttatgtatggggaaaaatggatactttttaaaccttttttggcagctcagatggtgtaaattttaaaattttgtataggtatttcataacaaaaatatgtatttcttttttgttattttatcttgaaaacggtacatattttagtatttgtgcagaaaaacaagtcctaaagtatttgtttttatttgtaccatccacttgtgccttactgtatcctgtgtcatgtccaatcagttgtaaacaatggcatctttgaacagtgtgatgagaataggaatgtggtgttttaaagcagtgttgcattttaatcagtaatctacctggtggatttgtttttaaccaaaaagatgaattatcaatgatttgtaattatatcagttgattttttttgaaaagatgaaccaaaggatttgactgctaatattttattccttacactttttttctgaataagtctctcataatgagtgcagtgtcagactgtgcctactctgatggtatgtgccatttgtaaaataaaatagagcagaaaaacacaaaaagagaacactggttcagacattcagtgggcaagtaaattatggactgcaaaataatgatttttattcaagaaagctttaaaagttttatatccagatatacaaccacaataaagcaaaataacctactatcaaaatagaaatgttgctatctttataagtgcaatttaatttgtaaatagagtttgaatcaaagtatcacaaaatactgcttcaagatttaattttaaatctgctaatttaagggatattgggaaaagttttggtgtgtttctgttgatttcttttttgtatgctgtgataaaagagaaatgaaaagtgccagtcactgtgtggtgtctaggaaaatcatatatatttttttctccaagaaataaattcatcctggacattggc

SEQ ID NO: 147948 - DNA, 2527 bp, Homo sapiens
  Payload ID: 9273
  Gene Symbol: LRRC1
  Gene Name: leucine rich repeat containing 1
  Uniprot ID: Q9BTT6
  ENST ID: ENST00000487251
  CDS Start-End: 642-1235
acttctggggcagccgtgagcagcgggcacacgggcagccacgaaagcagcagcgagggtggtgcaaacacctcaaaactacaccgaatccagtagcgcctggcgcccccggcgcgcaaggccgcctctactccgcctcatctttgtcccaagtcctttcacagtctgccttcctcaaacggcccgatgcgcccccgtctttgccggagtaagcagaccgccagcagccggcccgcaggtcagtcgaccctctctggatgcaggtcgccgggaaaacccggagcggagcatccctcgggccgggaaacgccctcggcgcgcacccactggcgcgcatgctcagtccgcgcggcggctgcgagtaggaagctccgcgcggcggcgggggcggcgacggcgactggcgggtgggagtggaggcaccggctggcgggcgggggtacagggacggggcaggggctcccgctccaggttccttgaagcacttccgaccgcgaagcccggcgcgagaagcgagctaacccaagagccaacaacgagcgcggagagggcagcggactgagcggagccgccggccagagcgggctcggagcccgggtctccgccgctcgggacccggctaggcggcggcgggggcggcgatgttccactgcatccccctgtggcggtgcaaccgtcatgtggagagcatcgacaagcgccactgctcgctggtctacgtccccgaggagatctaccgctatgcccggagcctggaggagctgctgctggacgccaaccagctccgcgagctgcccgagcaatttttccagctagtcaaattacgaaagcttggacttagtgataatgaaattcagcggctccctccagaaatagcaaacttcatgcagctggtggaactagatgtgtctcgaaatgagattcctgaaattccagaaagcatttcattctgtaaagcactgcaggtagctgacttcagcggaaacccactgactaggttgccagaaagctttcctgaattacagaatttaacatgtctttctgtaaatgacatctcactacagtctctacctgaaaatattggcaatctttataacctggcttcactggaactgagagagaatcttcttacatatcttcctgactctcttacccagctgcgaagactagaagaacttgatttaggaaacaatgaaatatataatttgaatcaattggagccctcttacatctaaaagatctctggttggatggaaatcaactgtcagaattacctcaggaaataggaaatctgaagaacctgctgtgtttagatgtctctgaaaacaggttggaaagacttcctgaagaaatcagtggcctgacttcattaacggatttagtcatttcccagaacttattagaaacgattccggatggcattggaaaactaaagaaactgtcaatcttgaaggtggatcagaatagactcacacagttgcctgaagcagttggggaatgtgaaagtctcactgagttagttcttacagaaaatcagctcctgaccctgcctaaaagcattggaaaactaaagaagttgagcaacttgaatgcagacagaaataaattagtgtccttaccaaaagaggtatgtgcttttagagaaatcacatgataataattatgaagaaataataataatacataagggatcaaaaatgtcaaatgctttgaaaagacgcatgtgttgttttttaaaggtgtgaactctaaatctgtgagtatagagccaactggaggaattatgtcaaagaatgatcatcagtaacattaaggagagttggaaaaggtgaatttataggattttaaatgggagaaagaaagagattgacattttgggtttgatatacagagaatggtgacaccattggcagaaattgataatttgggagtttgacagaggaagtggatgcctttgggtttgatttttgaatttaatgtgaaattaagctccatcccataagcaattggaattataaaaattgatcttgatgcaaccatatttctgggcagagatttacattgggccatgctcatgtcttggatgaggttgaacaaactgttcacaaaggcatacacatagaggaaggtgaatgggaagctaaagccagcttcctaggactttttttttggttagtagtctaagcacgagaaaatgagacatcaccatctgttgtggagagtagctgtatggactgagaggcatttaaattctggcaagggaggtggaaatgctgacaatgaggaggaagcttatagtgggtcaaacaaggaggtgtctagtgtgttgtttaaaaagaaggcttacaattagccaggcgtggtggcgggcgcctgtagtcccagctactcgggaggctgaggcaagagaattgcctgaacccgggaggctaaggttgcagtgagccgagaccacgccactgcactccagcccgggtgacagagcgagactctatctcaaaaaaaaaaaaaaaaaaaaaatgaaaag

SEQ ID NO: 147949 - DNA, 2599 bp, Homo sapiens
  Payload ID: 9274
  Gene Symbol: LRRC10
  Gene Name: leucine rich repeat containing 10
  Uniprot ID: Q5BKY1
  ENST ID: ENST00000361484
  CDS Start-End: 325-1158
gttaatattttatcattagggaaaaaaacagcaaagctattttcagcttgaaatgaaaaaaggttgataaaggggattggggcttaggtgattaaaggcaagcatgtgagtcagacatggcctcccagcccctgccggactgttgcgctgtcgccggacactcaagttgctatcaggagcacttttctctgtcaaagtgactggcttttgtcatgcaatccccaagttataatgggagggtaggataggccccagagcagtcagctgagccagccccgctcagtgagtctgtcctctggggctcgccatgcccccagcctccgcatggggaacaccatcagggccctcgtggccttcatccctgctgaccgttgccagaactatgtggtcagggacctccgtgagatgccgctggacaagatggtggatctgagtgggagccagttacgccgcttccccctgcacgtgtgctccttcagggagctggtcaagctctacctgagcgacaaccacctcaatagcctgcctccggagctggggcagctacagaacctgcagattctggccttggatttcaacaacttcaaggctctgccccaggtggtgtgcaccttgaaacagctctgcatcctctacctgggcaacaacaaactctgcgacctccccagtgagctgagcctgctccagaacctcaggaccctgtggatcgaggccaactgcctcacccagctgccggatgtggtctgtgagctgagtctccttaagactctgcatgccggctccaacgccctgcgtttgctgccaggccagctccggcgcctccaggagctgaggaccatctggctctcgggcaaccggctaactgactttcccactgtgctgcttcacatgcccttcctggaggtgattgatgtggactggaacagcatccgttacttccccagcctggcgcacctgtcaagtctgaagctggtcatctatgaccacaatccttgcaggaacgcacccaaggtggccaaaggtgtgcgccgtgtggggagatgggcagaggagacgccagagcccgaccctagaaaagccaggcgctatgcgttggtcagagaggaaagccaggagctacaggcaccagtccctctacttcctcctaccaactcctgaggagcttcagttgcaagtcaatgccaaggacccaactgcagcatgttctggaagcctctccattggagtggaaaggatggctctgggtcatttgggagtggctctgctagtagagactgatggagagagccaggtggaatgccataaatcacactgagaaaatatttctggcaaacagctcctcttccagaggggagttgtgtgccaatgatggcatgacaatccagagatcataacttctttgcaagaaaacagcttctccacacatgtattttgaaacactgaagagcaaaaggggctgggacactctgaactcctgcactctccagaagtgactggtcatgaagctcatgagctcctcaaataaggtatttgccatagaactaaatattctggtggtctgtctctttgcaggacatattttctttactgtaaatgaccataaacagtatcaatgtatcactgaggccaccgaaaaggacatttctacctaggcaatcagtcagattcacagaaaaaagttgtttgttgttgtaaaggctcaagatgaaactctttccccagcagtttagtgcctgctgaaaagatccctgatggacaatacttcttggtggactccagctgccccttttattattattagagacaaggtctcactctgttgctaggctggagtgcagtggcacaatcatggctcactgcagccccgaactactgggctcaagccttcctcccgcctcagcctgcccagtaactggtactacagatgtgcacacctggctaagtctttaattttttcgtagagatgaggtcttgctatgttgcccaagctagtttcaaactcctgggctcaagcgatgctcctgcttcagcctcccaaagtgctggggttacaggcatgagccaccacacccagccttcagctgtcaccttaaacttgacagtggctcatgctgatttagttcattttccctaaaaggtttgtcccaagatctgctcccaacagttgactgtcactgacaatgttggaagtcatctggaaaagagaacctctgtggtaatgtggtctcattaaagtcaagccttgttgtgattcctgtctacctccctgaagcaaagcccttctgtttattcacactaatgagccagagctgagctaaattgaatccctgtccttggaggaaaaccacatttccagaagcatgttagtttaaaggtagtaggtgagaaatgtgttctcttgaaacaagcactttgaaatttgaataggaagttgtagtgtatataggaagtctctgcctctttcgcctagtatctctgcctttgtttcaatttgttttgatttttacagactgttttgacaatgtataaaccaaggtattttgttttttggaagtatgtaaattgtgaccttcccacaaatatataaactttaaagaaa

SEQ ID NO: 147950 - DNA, 2219 bp, Homo sapiens
  Payload ID: 9275
  Gene Symbol: LRRC10B
  Gene Name: leucine rich repeat containing 10B
  Uniprot ID: A6NIK2
  ENST ID: ENST00000378075
  CDS Start-End: 200-1078
cgcggcgcgcggcggcggtgccccaagtgggtgcctcctcccggccccgcacggcccccctcccggcgcgggggaaggccggggcggggggcccgggggccggcgcggctccggcaccgtcggggcggctggggggcggccggggcggggcgatgcctggcggtggcagtggcggcggccccggccggggcccgtgaccatgggcatcgccgagtccacgccggatgagctgccgtcggacgcagaggagcagctgcgcagcggcgaccagcagctggagctgagcgggcggcggttgcggcggctgcccagcgcagtgtgcgcgctgagccgcctgcagaagctgtatgtgagcggcacggggctgcgcgagctgccggaggagatcgaggagctgcgcgagctgcgcatcctggcgctggacttcaacaagctcgagcgactgcctgacggcctgtgccgcctgccgcgcctcacgcgcctctatctgggcggcaaccggctgctggcgctgcccgccgacttcgcgcagttgcagagcctgcgctgcctctggatcgagggcaacttcttgcggcgcttcccgcggccgctgctgcgcctggtggcgctgcagtcgctccagatgggcgacaaccggctgcgcgcgctgccggccgagctgccgcgcatgacgggcttgcgcggcctctggctctacggcaaccgcttcgaggagttcccgcccgcgctgctgcgcatgggccgcctgcacatcctcgacctcgaccgcaaccgcctgggcggcttccccgacctgcacccgctgcgcgcgctgcgcgtcttctcctacgaccacaaccccgtcaccgggcccccgcgcgtcgcggacaccgtgttcctcgtgggcgagggcgccgtcgagcgcatggcggagcgcgacgagcccacgccccggcctccgccccggcgcccagcgcgggcctttgaggatgaggaggaggaagacctgctcataggcggcgctggttcccgggctctgggcgcccccgggggcagcttccgcgccctggaagccgctccaggactgggcacctgagcctatgttctggctgatgggcttcagccactctgagaggaggggctctaggaagctttggctggttaggcctgcgggactggtgggtccctacttaggtcaatggaacggctacttttggcgagttgccgggcacaggcagggctggggctcatcttcagacactcctaggtagtaagaggactgactataccctggctgatctgtgggcaattgtcagaccaagaagtctgggctgggtccagtccccgatggagccactgataacagaggcaccagcttcctcctggaaccagggtctctgagggccacagaattgtcacgtctccctgagtctggatgcagggcacccaacaccctccctctttctggggtttgggtctcctaggcccaccctttctaggacaggagccgctacctctgggatggactgcgtgcctgtgtggggcaggactgcccttgcgaggagggcctggcccaggagcaggggcttggagtggggctggtgcccgggacagaagtgggaaatagatgggggccccaacaccgaagctgccctcacccctccatcagggctgatcgtacatacctccctcctcggccccctgagattggtatggggcacagaaggcagggggtcacccccaccctattctgttctcttctcccagcctcccagcatgtgcctggaaccttgctgggaagagagagctccccctccactccccaccccatagcctgagccttccagctgtcaagtttgaaaagaagccaccgtgcctccagggcctcctgcaccgcagagaggggctctctgctctgggaggctgctcagcgcctctcccacggcctgcactctcctttcccttaaatgggcacagccagggtggctggcatgggactggcactctgtacctccactccgtcaccagggacagccccgagggggtgaggagaggggccttgctctgcaattcccagagccagatcttcctcatccaagcaataacgggacgagggagccagggccaaggacactcagggacactgttggggcagcggccccacatggtaatgttttctttagagagaagaaaaaacaactggctgtaaacgtaaattatatttcttggagaaagaa

SEQ ID NO: 147951 - DNA, 5328 bp, Homo sapiens
  Payload ID: 9276
  Gene Symbol: LRRC14
  Gene Name: leucine rich repeat containing 14
  Uniprot ID: Q15048
  ENST ID: ENST00000292524
  CDS Start-End: 147-1628
cggggctggaggcggtggctgcggttgcgggaccggcactatgctgggccttcctaccacttgtgtgtggcttggtagtggcctagggtctctcctccctgctgaagtccctctcctgcaggtggccgtctgcccggcccagcaccatgcacacgcttgtgttcttgagcacacggcaggtgctgcagtgccagccagctgcctgccaggccctgcccttgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggctgttatcctggggctgactgcccggctccacacctcagagcctggggccagcacacagcccctctgcaggaagcatgcgctgcgggtgctggacatgacgggcctcttggatgatggtgtggaacaggatcctggcaccatgagcatgtgggactgtactgctgccgtagctcgcacatgcattgcccagcagcagggtggggccgcagagcctgggccagcccccatccccgtggaggtgcgcgtggacctgcgggtgaaccgggcctcctatgcgttcctgcgggaggcactccgaagcagcgtgggcagcccgctgcggctctgctgccgggacctgcgagctgaggacctgcccatgcgcaacactgtggccctgctgcagcttctggatgcaggctgcctgcgccgcgtggacctgcgcttcaacaatctgggcctgcgcggcctgtctgtgatcatcccacacgtggcccgcttccagcacctggccagcctgcggctccactatgtgcatggggattcaaggcagccctccgtggatggcgaggacaacttccgctacttccttgcccagatgggccgcttcacctgtctgcgtgagctcagcatgggctcctctctcctttcagggaggctggaccagctgctcagcaccctgcagagccccctggagagcctggagttggccttctgtgctctgctgcctgaggacctacgcttcctggcacggagcccacatgctgcccacctcaagaagttggacctgagtggtaacgacctgtctggcagccagctggcacccttccagggtctgttgcaggcatcagcagccacactgttgcatctggagctgactgagtgtcagctcgcagacacccagctgttggccacactacccatcctgactcagtgcgccagtctccggtaccttggcctctatggcaacccactgtccatggcgggcctcaaggagctgctgcgggactcagtggcacaggctgagctgcgtactgtggtgcaccccttccctgtggactgctatgagggcttgccctggccgccgcctgcctctgtcctgctggaggcctccatcaatgaggagaagtttgcccgcgtagaagctgagttgcaccagctgcttctagcctcaggccgtgcccatgtgctctggaccacggacatctacgggcgactggctgcggactacttcagcctatgatgaagtagctctgggtgagacacaggccgccctgcagtctctttaggtaggcagggcctttgctgggacccctggtggaggccttcacaaaagcactggttactggtttcctgctgggtctaccttgcttctgggcacacctcaagcctcccctgctttctgcagtgccccacgcggttttccctgcacttgctccataattggctgatcatctgtgggccccggggctggatgtcaggcctccattgccctgctcagtttggctgcatttggctgccgtctggggtcctggtcctttgtgcaaatgctttgggattccagttgtgagctgagagagatgatggcctctctgggcctttcctctccctttactgagagctcagtgcttctggggttgaagttggacagaggcctgcttcagggaagctgggagtccccaggcactcacgcctcttacgtgttccctaccctgccacccagccaccccactgggctgggctcgggctggagggggtcatcaaggtacacatgtgcctggaagttgaatttgtggctgtttttttttctgtccacgttggtcacccttatccttatctctgctgtcacccccaacatggccacccggcaacaactgccatccagcctgtcgccccgcccttcgcggggcagccccgtcggcactgccggccagtccttgctcttcccacctttcggaggcccaagatcctactgtggccggccagggccagcgagggaccccccccatgcagagctggaggttggggtgatgtcttttcggaagagcttcaagggaggtgttggggcctccccggccaccttccattgctaccccaggattcccgagtgcaacgttcccggctcgcgccccacacacggctcagcgcacactgcgcggcttccacctttactgacggagcatgcgcgaggccgcaccggccaatctccggcgcccacgtcatccgcgcgcccgcggccctagcagtggatctcgtaggcgaccggcgggggcacgcggagtcccggccccgccccctgttccgggccgcagtcagcgggcgcctccgccggaccctcggcgaagagcggcttggagcggttgatgacgaacatctcgtggccgcgctcgtcgcggagctcctctagctgtgcgaacgtacaggggccgtccaagtagtcgttgacgaacagcgctccctcccccggaggcccccgcgccttttttcgcctgcggcgccggcgacagatcatggcgaccaggagcagcgccgtgagcgccagcagcgcgatggccgccgcaatggccgtctgtgtggccacgcccagggcgcggaaggccatgctgcccgcctcgggccggggctcgctgccggcggggcgggcggccggaggcggcggttgcgcgggctgctgcggctgctgccgggacgcgttgaccaggagccggaagggcacgcgggcagcgccgccggcgttggaggcctcgcactcgtacttaccggcgtgcgccagcgtgatgttgctgaggaagagcatgccgctgcccgtgtcggatgccgagtgtccgcccaggcccagcaacccgccttctagctgggcctgggctcgcggccggccctcgcgaggctggggcacctttctccaggtcaccaatggctgcgggtagccggaggcttggcaggcaacccgcaggtcctcacccaggttggctgtgagctccagcggctgcacgtggacagagggcggaatgcagatgaggctgctgtgggatacgtccaggagactctggagcgccaggcgcgggggctctgcacacatgatcttcctgtccctggaggtgagcagccgctggccgccctccttgatccaggcacccagccagtgcagggcgcagtcacagcgccatgggttctctgtgggagagcagcgttaggcaggtggcttgagggtgctgctaaaacagcctgtgcagttggggttttgcaggccaggacagaggcctctttcccacctcccacagcgttttcacacggagtccaaggccctgccaccccttccttgaccccaagctccttggggcggcaggcccttcaccctcgcccccctcccctttagctctgtgatgcctgcctgttacagatcacttctccgtcggtctctgagaaagcacctgctccttaagtcttcctgcaacaagtgccactgtttttaggaacctgggcgtccacatagacatctcaccagcactgaaacctcacaagtcctctcagccttgcctttggatgccctctcttgggaatgtccccagtcctggtcagctgtctctctcctttgcaattttgtctgcctcccctcagcctaaaagtgtgcagaaccctcaattctgttaagtcaccctgtggagttcctgtcttctgttttccccaggcagggtgcctgagctgtattccccagcacacccactcccgcagccctccagtgtggctgcaggcggtggtgcagccttccagactgctgcccagttgcctgatgtcagagcccctccacacatgagcctgctccctactgccaacaccgtggcccagacagagacgctttccgaggaagaggtacctgtgaggcgcaggacttgcagactggccaggggctgcagggcctctcggctgatggtgcccagctggttcctgctgaggtccagcagtgctagggaggacagccccgctagagcctggtcctccagcagctcaatgctgttttcttgcaggtgaagctcctgcagtcgctgaagtaaggacagcagatcgtgaggaaaaagggcgccgaggttgggggcatgtctctcttcttaccaagctagactgggttgccttttctaactattccagccctacagggcgaggggccataatggagtatcccgcccctttagaccccaggcgctcaccggcaggtgcaagaaggtgaaatccagcagccgcgccagctggttgcccgccaggtagagcacgcgcagctgggccaggcctacgaaggcgccgctgcgcaagccgcgcagccggttgctagtgagcgccagctccagcaggcgcggctgcgcgcggaaggcgccggcctccagggcgcgcaggctgttgttgtgcaggtagagccggcgcagagcggcgagtggcgccagggctcccggctctaggcgggcgatgttgttgtcctgcaggaacagtgtctgcaggccggggaaagaggaggcgcttaccccgttgcgggggtcttcctctccctgggggcaccccgtcctcccgcagctccacacggtgcccacctgcgtccctggcgggattcccagcgggacgacgcgcaaccgcagggcgccacactccaccgtggcgctgtagcagcggcaggctgctgggcagccggcggcgcggagcggcagtagtagcagcagcagcggcagcagtgcgggggccctcagggccatctcccgaggcccggttcctcaccggcccttccgcggttcagccgcagacgcgtgccctcctgaaacacaggttggcaggccagtctcggcagtcgagagccagccaatagatggaatggaggcctgcacctgcgtctaacttttgacgctataaataggttcaagaaactaataaaacgttctggttttctcctttgacaaaaa

SEQ ID NO: 147952 - DNA, 661 bp, Homo sapiens
  Payload ID: 9276
  Gene Symbol: LRRC14
  Gene Name: leucine rich repeat containing 14
  ENST ID: ENST00000525766
  CDS Start-End: 183-661
acagggagatggctgcgatttagttttgaggatgctacaggcagcagcagggctggcaccctgtgtcacaggcactatgctgggccttcctaccacttgtgtgtggcttggtagtggcctagggtctctcctccctgctgaagtccctctcctgcaggtggccgtctgcccggcccagcaccatgcacacgcttgtgttcttgagcacacggcaggtgctgcagtgccagccagctgcctgccaggccctgcccttgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggctgttatcctggggctgactgcccggctccacacctcagagcctggggccagcacacagcccctctgcaggaagcatgcgctgcgggtgctggacatgacgggcctcttggatgatggtgtggaacaggatcctggcaccatgagcatgtgggactgtactgctgccgtagctcgcacatgcattgcccagcagcagggtggggccgcagagcctgggcc

SEQ ID NO: 147953 - DNA, 2243 bp, Homo sapiens
  Payload ID: 9276
  Gene Symbol: LRRC14
  Gene Name: leucine rich repeat containing 14
  Uniprot ID: Q15048
  ENST ID: ENST00000529022
  CDS Start-End: 216-1697
ggcggggctggaggcggtggctgcggttgcgggaccgggagatggctgcgatttagttttgaggatgctacaggcagcagcagggctggcaccctgtgtcacaggcactatgctgggccttcctaccacttgtgtgtggcttggtagtggcctagggtctctcctccctgctgaagtccctctcctgcaggtggccgtctgcccggcccagcaccatgcacacgcttgtgttcttgagcacacggcaggtgctgcagtgccagccagctgcctgccaggccctgcccttgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggctgttatcctggggctgactgcccggctccacacctcagagcctggggccagcacacagcccctctgcaggaagcatgcgctgcgggtgctggacatgacgggcctcttggatgatggtgtggaacaggatcctggcaccatgagcatgtgggactgtactgctgccgtagctcgcacatgcattgcccagcagcagggtggggccgcagagcctgggccagcccccatccccgtggaggtgcgcgtggacctgcgggtgaaccgggcctcctatgcgttcctgcgggaggcactccgaagcagcgtgggcagcccgctgcggctctgctgccgggacctgcgagctgaggacctgcccatgcgcaacactgtggccctgctgcagcttctggatgcaggctgcctgcgccgcgtggacctgcgcttcaacaatctgggcctgcgcggcctgtctgtgatcatcccacacgtggcccgcttccagcacctggccagcctgcggctccactatgtgcatggggattcaaggcagccctccgtggatggcgaggacaacttccgctacttccttgcccagatgggccgcttcacctgtctgcgtgagctcagcatgggctcctctctcctttcagggaggctggaccagctgctcagcaccctgcagagccccctggagagcctggagttggccttctgtgctctgctgcctgaggacctacgcttcctggcacggagcccacatgctgcccacctcaagaagttggacctgagtggtaacgacctgtctggcagccagctggcacccttccagggtctgttgcaggcatcagcagccacactgttgcatctggagctgactgagtgtcagctcgcagacacccagctgttggccacactacccatcctgactcagtgcgccagtctccggtaccttggcctctatggcaacccactgtccatggcgggcctcaaggagctgctgcgggactcagtggcacaggctgagctgcgtactgtggtgcaccccttccctgtggactgctatgagggcttgccctggccgccgcctgcctctgtcctgctggaggcctccatcaatgaggagaagtttgcccgcgtagaagctgagttgcaccagctgcttctagcctcaggccgtgcccatgtgctctggaccacggacatctacgggcgactggctgcggactacttcagcctatgatgaagtagctctgggtgagacacaggccgccctgcagtctctttaggtaggcagggcctttgctgggacccctggtggaggccttcacaaaagcactggttactggtttcctgctgggtctaccttgcttctgggcacacctcaagcctcccctgctttctgcagtgccccacgcggttttccctgcacttgctccataattggctgatcatctgtgggccccggggctggatgtcaggcctccattgccctgctcagtttggctgcatttggctgccgtctggggtcctggtcctttgtgcaaatgctttgggattccagttgtgagctgagagagatgatggcctctctgggcctttcctctccctttactgagagctcagtgcttctggggttgaagttggacagaggcctgcttcagggaagctgggagtccccaggcactcacgcctcttacgtgttccctaccctgccacccagccaccccactgggctgggctcgggctggagggggtcatcaaggtacacatgtgcctggaagttgaa

SEQ ID NO: 147954 - DNA, 730 bp, Homo sapiens
  Payload ID: 9276
  Gene Symbol: LRRC14
  Gene Name: leucine rich repeat containing 14
  ENST ID: ENST00000530854
  CDS Start-End: 471-730
cttcgcgaaacgcaggcgaccgaggaccgtcgcgttccctgcggccggcgggaggggagggggcgtcgcacggaggtgcctgcctcccttggtgggcaggccgtctgctttggtgttctcccgtgacaagtgctcggttggtctgtcctgtcagagcgagtatgatcgttgagatctgtccaccggcagaactaggccgagggttggtgtctgggacttttcaggaaccggtgccttaaggacttacttgtatgtggaaaagtcgacaaaaagaagggccttggggccagagtgtcttccccggcccccttccctggcttgtcactcaggctgtgaccttgggccaggccgaggccttcattttctaatctgtcacagggagatggctgcgatttagttttgaggatgctacaggcagcagcagggctggcaccctgtgtcacaggtggccgtctgcccggcccagcaccatgcacacgcttgtgttcttgagcacacggcaggtgctgcagtgccagccagctgcctgccaggccctgcccttgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggc

SEQ ID NO: 147955 - DNA, 978 bp, Homo sapiens
  Payload ID: 9276
  Gene Symbol: LRRC14
  Gene Name: leucine rich repeat containing 14
  ENST ID: ENST00000527730
  CDS Start-End: 76-978
ggcggacggtctaggcggggctggaggcggtggctgcggttgcgggaccggtggccgtctgcccggcccagcaccatgcacacgcttgtgttcttgagcacacggcaggtgctgcagtgccagccagctgcctgccaggccctgcccttgctgccacgcgaactcttccccctgctgttcaaggtggccttcatggacaagaagacagtggtactgcgcgagttggtacacacgtggcccttcccgctgctcagtttccagcagctgctacaggagtgtgcccactgcagccgtgccctcctgcaggagcggcctagcactgagagcatgcaggctgttatcctggggctgactgcccggctccacacctcagagcctggggccagcacacagcccctctgcaggaagcatgcgctgcgggtgctggacatgacgggcctcttggatgatggtgtggaacaggatcctggcaccatgagcatgtgggactgtactgctgccgtagctcgcacatgcattgcccagcagcagggtggggccgcagagcctgggccagcccccatccccgtggaggtgcgcgtggacctgcgggtgaaccgggcctcctatgcgttcctgcgggaggcactccgaagcagcgtgggcagcccgctgcggctctgctgccgggacctgcgagctgaggacctgcccatgcgcaacactgtggccctgctgcagcttctggatgcaggctgcctgcgccgcgtggacctgcgcttcaacaatctgggcctgcgcggcctgtctgtgatcatcccacacgtggcccgcttccagcacctggccagcctgcggctccactatgtgcatggggattcaaggcagccctccgtggatggcgaggacaacttccgctacttccttgcccagatgggccgcttcacctgtctgcgtgagctcagcatgggctcctctctcctttcagggaggctggac

SEQ ID NO: 147956 - DNA, 1573 bp, Homo sapiens
  Payload ID: 9277
  Gene Symbol: LRRC14B
  Gene Name: leucine rich repeat containing 14B
  Uniprot ID: A6NHZ5
  ENST ID: ENST00000328278
  CDS Start-End: 29-1573
gtcgtggggagcggtcctgtctcgggccatggacacaatgaggtcactccgcttcatttctgcagaagctctggtgtcccacccccaggtggcccggcagagcctggacagcgtggcccacaacctctacccactcctgttcaaagccagctacctgctggagcaggcggaggtgacgcgcgcggtgctggggcgctggcccctggaggagttccggctgggagcgctgctgggtcctggtgccgaccacccccaggacctgcgcgacagaacctgcagggcctgcctggaggcgctggtgcgcggcctcgcggaccacgtgctgcaggaccggagccgccggcggctgcgggtggctgacctcacgggcatccgagatgtgcaggtgcagcggtgcccgtgcgggagggcgctgggcaggtggggccgcacccagctgctggccaggacctgctgtgagctgcaggcagagcccctcgcagccgggcgccccgtcgaggtcctcgccgacctcttcgtcactgagggcaacttcgaggcggtggtgcaggctctgaggccagcgggcccggcccctctgcgggtgcactgcccctcgttccgggcggacagcctgagccccagccagctcctgcacgtgctgcgtctggctggcccgggtgccctgcgcaagctggaggtggtgcacaacgtgcggctgcatgcgggccacgtgcagcagcttctggcccaggtgggcttcccccggctggcctcgctcaccctgcccaccaaggcctttgatgcaccccccacctacgcctccactcccgacggcgaggaccccctcctcgcctccatcgcccgggagctcagcaagatggcgcagctcactgagctcagtgtggccttctccacgctgaccgggaagatcccgacgctgcttggccccctacagaccccgctgcgagtactggacctggccaactgtgccctgaaccacacggacatggccttcttggcagactgtgcccacgctgcccacctggaggtgctggacctcagtggacacaacctggtcagcctgtacccctcgaccttcttcaggctgctcagccaggcttcccggacgctgaggatcctgacactggaggagtgtggcatcgtagacagccacgttggcatgctgatcctgggcctgagcccctgccaccggctgcgccagctcaagttcctcgggaacccgctgtcggcccgcgccctccggcgcctcttcaccgcactctgtgagctccccgagctgcgctgcattgagttcccggtgcccaaggactgctaccccgagggtgccgcctacccacaggacgagctggccatgtccaagttcaaccagcagaaatacgacgagatcgccgaggagctgcgtgccgtgctgctgcgggctgaccgagaggacatccaagtctccacacctctctttggaagttttgacccagacattcaagaaacaagcaatgagcttggtgctttcttgctgcaagctttcaaaactgctctagaaaacttctccagagcactcaaacaaatagagtag

SEQ ID NO: 147957 - DNA, 5883 bp, Homo sapiens
  Payload ID: 9278
  Gene Symbol: LRRC15
  Gene Name: leucine rich repeat containing 15
  Uniprot ID: Q8TF66
  ENST ID: ENST00000347624
  CDS Start-End: 87-1832
acactcatgctgcagccttgagccgtccctcgtcctcctctcaggctccctcttgtccacggcgggcgggcgccgagctgctggctatgccactgaagcattatctccttttgctggtgggctgccaagcctggggtgcagggttggcctaccatggctgccctagcgagtgtacctgctccagggcctcccaggtggagtgcaccggggcacgcattgtggcagtgcccacccctctgccctggaacgccatgagcctgcagatcctcaacacgcacatcactgaactcaatgagtccccgttcctcaatatctcagccctcatcgccctgaggattgagaagaatgagctgtcgcgcatcacgcctggggccttccgaaacctgggctcgctgcgctatctcagcctcgccaacaacaagctgcaggttctgcccatcggcctcttccagggcctggacagcctcgagtctctccttctgtccagtaaccagctgttgcagatccagccggcccacttctcccagtgcagcaacctcaaggagctgcagttgcacggcaaccacctggaatacatccctgacggagccttcgaccacctggtaggactcacgaagctcaatctgggcaagaatagcctcacccacatctcacccagggtcttccagcacctgggcaacctccaggtcctccggctgtatgagaacaggctcacggatatccccatgggcacttttgatgggcttgttaacctgcaggaactggctctgcagcagaaccagattggactgctctcccctggtctcttccacaacaaccacaacctccagagactctacctgtccaacaaccacatctcccagctgccacccagcgtcttcatgcagctgccccagctcaaccgtcttactctctttgggaattccctgaaggagctctctccggggatcttcgggcccatgcccaacctgcgggagctttggctctatgacaaccacatctcttctctacccgacaatgtcttcagcaacctccgccagttgcaggtcctgattcttagccgcaatcagatcagcttcatctccccgggtgccttcaacgggctaacggagcttcgggagctgtccctccacaccaacgcactgcaggacctggacgggaacgtcttccgcatgttggccaacctgcagaacatctccctgcagaacaaccgcctcagacagctcccagggaatatcttcgccaacgtcaatggcctcatggccatccagctgcagaacaaccagctggagaacttgcccctcggcatcttcgatcacctggggaaactgtgtgagctgcggctgtatgacaatccctggaggtgtgactcagacatccttccgctccgcaactggctcctgctcaaccagcctaggttagggacggacactgtacctgtgtgtttcagcccagccaatgtccgaggccagtccctcattatcatcaatgtcaacgttgctgttccaagcgtccatgtccccgaggtgcctagttacccagaaacaccatggtacccagacacacccagttaccctgacaccacatccgtctcttctaccactgagctaaccagccctgtggaagactacactgatctgactaccattcaggtcactgatgaccgcagcgtttggggcatgacccaggcccagagcgggctggccattgccgccattgtaattggcattgtcgccctggcctgctccctggctgcctgcgtcggctgttgctgctgcaagaagaggagccaagctgtcctgatgcagatgaaggcacccaatgagtgttaaagaggcaggctggagcagggctggggaatgatgggactggaggacctgggaatttcatctttctgcctccacccctgggtccatggagctttcccgtgattgctctttctggccccagagaaaggtgagcctacctcttcctgacttgcctgattctcccgtagagaagcaggtcgtgccggaccttcctacaatcaggaagatagatccaactggccatggcaaaagccctggggatttccgattcatacccctgggcttccttcgagagggctcttcctccaaatcctccccacctgtcctccaagaacagccttccctgcgcccaggccccctccgggcctctgtagactcagttagtccacagcctgctcacttcgtgggaatagttctccgctgagatagcccctctcgcctaagtattatgtaagttgatttcccttcttttgtttctcttgtttgtgctacggcttgacccagcatgtcccctcaaatgaaagttctccccttgattttctgctcctgaaggcagggtgagttctctcctcaaagaagacttcaaaccatttaactggtttcttaagagccgtcaatcagcctggttttggggatgctatgaaagagagaaggaaaatcatgccgctcagttcctggagacagaagagccgtcatcagtgtctcacttgtgatttttatctggaaaaggaagaaacaccccagcacagcaagctcagccttttagagaaggatatttccaaactgcaaactttgctttgaaaagtttagccctttaaggaatgaaatcatgtagaattttggacttctaaaaacattaaaatcagcttattaatacgggatagagaaagaaatctggtgcctgggggtccctgtgttcacccctagagtttgttttaaaatttttaattgaagcatgtgaagtgtacgtgcagaaaagtgggaacatgatagtgtatggcttggtggattttcacaaactgaacatacctgtgtaatcagcatctagacccagacccagagcatcacaaatatcccccatcctgggcttttcccagaggagatgggggcttctgaagatggacttacctgggacctgccccccatgagccaggacggtccccccacagtcagcctgtgcaaaggccccgtggccaggggtggaggagaatatgtgggtgtggacaggatgggagactgtggcctgaacaggagattttattatatctggagaccctgagagaccctgagacctggggcaccatggctggccaggtcagaagcatcctgactgcagaggtccgtgcagccacaccctcttccctgccagcaagctgtctgcggctcatcggaggcccctccgcctggagccttctatggacgtgatatgcctgtatctgtttttaattttcattcttcacttaggggaagtgaaatcgctcagagatgagatcctttaattgaaaacgaagtgtaacggaatctagtgtctttctaatgtggtaaaattctccatcaacatcacagtcagctggcagctgaacttcagaatctcacttacagcaggcgacacgggggtacaccgatgggtcacactgggtctgggggctccctggagctcctcctgcgtgtggtctggttaggagttgagttgtttgctccagggttattctcctcctcgagtcacagtcacacgaatacctgccttctctggctttcctgctatacacatattcacatggcgctcaagaagttaggctcatggcaacgtgtgtctttctctggacaactggcccagtttacagtgaaatggagaatttcaggtctccacgtctgcccaggaaagaacttcagctgactccacggggatctggaaatccacgaccaatcccgatcggctcttattagctccccgctccacaagacacctgtgctttggaaatccaccaccaatcccgatcggctcttattagctccccgctccacaagacacctgtgatctggaaatctaccaccaatcccgatcggctcttattagctccccgctccacaagacacctgtgacatcctccagggccacaggagcacgtgctgaccagttttcccttccagttcctgcacaaaaagtgtccagagggctgtttgcaaacactagtgcactttgtagcttttcaccctctgtcccagggaatctaggagagatgaggcccgtcagagtcaagagatgtcatccccccagggtctccaaggcatttccacactattggtggcacctggaggacatgcaccaaggcttgccagagccaacaggaagtgagcccagagcatggcacatgagcatcacccgctgatggtggcctgctgtgcctggtgccaacaggggcatcccggcccgtacccctccagacaggaagcatgggtttgcccacagacctgtcgggtgctcctgtgagtggcctccagatgtctttgtgcataggcacaagtgggccagggctggagggaggtgggaaacctcatcatccggtgggccctgccaatcttaacccagaacccttaggtattcctggcagtagccatgacattggagcaccttcctctccagccagaggctgacctgagggccactgtcctcagatgacaccacccaggagcaccctaggtgaggggtgagggcccccttatgtgaacctcttgcctcttcctttctcccatcagagtggttggatggagccattggcctccttttcttcagcgggcccttcaacctctctgcaccatgttgtctggctgaggagctactagaaaagctgagtggagtctcctttccaacaggatgatgcatttgctcaattctcagggctggaatgagccggctggtcccccagaaagctggagtggggtacagagttcagttttcctctctgtttacagctccttgacagtcccacgcccatctggagtgggagctgggagtcagtgttggagaagaaacaacaaaagccaattagaaccactatttttaaaaagtgcttactgtgcacagatactcttcaagcactggacgtggattctctctctagccctcagcacccctgcggtaggagtgccgcctctacccacttgtgatggggtacagaggcacttgctcttctgcatggtgttcaataggctgggagttttatttatctcttcaaactttgtacaagagctcatggcttgtcttgggctttcgtcattaaaccaaaggaaatggaagccattcccctgttgctctccttagtcttggtcatcagaacctcacttggtaccatatagatcaaaagctttgtaaccacaggaaaaaataaactcttccatcccttaaagaatagaatagtttgtccctctcatgggaattgggctgtatgtatattgttcttcctccttagaatttagagatacaagagttctacttagaacttttcatggacacaatttccacaacctttcagatgctgatgtagagctattgggaaagaacttccaaactcaggaagtttgcagagagcagacagctagagataactcgggacccagagttggtcgacagatgttagatgtatcctagcttttagctataaaccactcaaagattcagcccccagatcccacagtcagaactgaatctgcgttgttgggaagccagcagtggccttgggaaggaagccatggctgtggttcagagagggtgggctggcaagccacttccggggaaaactccttccgccccaggtttcttcttctcttaaggagagattgttctcaccaacccgctgccttcatgctgccttcaaagctagatcatgtttgccttgcttagagaattactgcaaatcagccccagtgcttggcgatgcatttacagatttctaggccctcagggttttgtagagtgtgagccctggtgggcagggttggggggtctgtcttctgctggatgctgcttgtaatccatttggtgtacagaatcaacaataaataatatacatgtata

SEQ ID NO: 147958 - DNA, 3248 bp, Homo sapiens
  Payload ID: 9278
  Gene Symbol: LRRC15
  Gene Name: leucine rich repeat containing 15
  Uniprot ID: Q8TF66
  ENST ID: ENST00000428839
  CDS Start-End: 114-1877
cagccttgagccgtccctcgtcctcctctcaggctccctcttgtccacggcgggcgggcgccgagctgctgatgtgtccctagcataacctggccccattcctttgcatctagatgcctttggacaaggctatgccactgaagcattatctccttttgctggtgggctgccaagcctggggtgcagggttggcctaccatggctgccctagcgagtgtacctgctccagggcctcccaggtggagtgcaccggggcacgcattgtggcagtgcccacccctctgccctggaacgccatgagcctgcagatcctcaacacgcacatcactgaactcaatgagtccccgttcctcaatatctcagccctcatcgccctgaggattgagaagaatgagctgtcgcgcatcacgcctggggccttccgaaacctgggctcgctgcgctatctcagcctcgccaacaacaagctgcaggttctgcccatcggcctcttccagggcctggacagcctcgagtctctccttctgtccagtaaccagctgttgcagatccagccggcccacttctcccagtgcagcaacctcaaggagctgcagttgcacggcaaccacctggaatacatccctgacggagccttcgaccacctggtaggactcacgaagctcaatctgggcaagaatagcctcacccacatctcacccagggtcttccagcacctgggcaacctccaggtcctccggctgtatgagaacaggctcacggatatccccatgggcacttttgatgggcttgttaacctgcaggaactggctctgcagcagaaccagattggactgctctcccctggtctcttccacaacaaccacaacctccagagactctacctgtccaacaaccacatctcccagctgccacccagcgtcttcatgcagctgccccagctcaaccgtcttactctctttgggaattccctgaaggagctctctccggggatcttcgggcccatgcccaacctgcgggagctttggctctatgacaaccacatctcttctctacccgacaatgtcttcagcaacctccgccagttgcaggtcctgattcttagccgcaatcagatcagcttcatctccccgggtgccttcaacgggctaacggagcttcgggagctgtccctccacaccaacgcactgcaggacctggacgggaacgtcttccgcatgttggccaacctgcagaacatctccctgcagaacaaccgcctcagacagctcccagggaatatcttcgccaacgtcaatggcctcatggccatccagctgcagaacaaccagctggagaacttgcccctcggcatcttcgatcacctggggaaactgtgtgagctgcggctgtatgacaatccctggaggtgtgactcagacatccttccgctccgcaactggctcctgctcaaccagcctaggttagggacggacactgtacctgtgtgtttcagcccagccaatgtccgaggccagtccctcattatcatcaatgtcaacgttgctgttccaagcgtccatgtccccgaggtgcctagttacccagaaacaccatggtacccagacacacccagttaccctgacaccacatccgtctcttctaccactgagctaaccagccctgtggaagactacactgatctgactaccattcaggtcactgatgaccgcagcgtttggggcatgacccaggcccagagcgggctggccattgccgccattgtaattggcattgtcgccctggcctgctccctggctgcctgcgtcggctgttgctgctgcaagaagaggagccaagctgtcctgatgcagatgaaggcacccaatgagtgttaaagaggcaggctggagcagggctggggaatgatgggactggaggacctgggaatttcatctttctgcctccacccctgggtccatggagctttcccgtgattgctctttctggccccagagaaaggtgagcctacctcttcctgacttgcctgattctcccgtagagaagcaggtcgtgccggaccttcctacaatcaggaagatagatccaactggccatggcaaaagccctggggatttccgattcatacccctgggcttccttcgagagggctcttcctccaaatcctccccacctgtcctccaagaacagccttccctgcgcccaggccccctccgggcctctgtagactcagttagtccacagcctgctcacttcgtgggaatagttctccgctgagatagcccctctcgcctaagtattatgtaagttgatttcccttcttttgtttctcttgtttgtgctacggcttgacccagcatgtcccctcaaatgaaagttctccccttgattttctgctcctgaaggcagggtgagttctctcctcaaagaagacttcaaaccatttaactggtttcttaagagccgtcaatcagcctggttttggggatgctatgaaagagagaaggaaaatcatgccgctcagttcctggagacagaagagccgtcatcagtgtctcacttgtgatttttatctggaaaaggaagaaacaccccagcacagcaagctcagccttttagagaaggatatttccaaactgcaaactttgctttgaaaagtttagccctttaaggaatgaaatcatgtagaattttggacttctaaaaacattaaaatcagcttattaatacgggatagagaaagaaatctggtgcctgggggtccctgtgttcacccctagagtttgttttaaaatttttaattgaagcatgtgaagtgtacgtgcagaaaagtgggaacatgatagtgtatggcttggtggattttcacaaactgaacatacctgtgtaatcagcatctagacccagacccagagcatcacaaatatcccccatcctgggcttttcccagaggagatgggggcttctgaagatggacttacctgggacctgccccccatgagccaggacggtccccccacagtcagcctgtgcaaaggccccgtggccaggggtggaggagaatatgtgggtgtggacaggatgggagactgtggcctgaacaggagattttattatatctggagaccctgagagaccctgagacctggggcaccatggctggccaggtcagaagcatcctgactgcagaggtccgtgcagccacaccctcttccctgccagcaagctgtctgcggctcatcggaggc

SEQ ID NO: 147959 - DNA, 5431 bp, Homo sapiens
  Payload ID: 9279
  Gene Symbol: LRRC16A
  Gene Name: leucine rich repeat containing 16A
  Uniprot ID: Q5VZK9
  ENST ID: ENST00000329474
  CDS Start-End: 369-4484
tgggcgggagctacgccggcccaagccccgccggggaccagcgagccgggaggaggagcaggcgccacagccgccccgcgccccgcgcccgcttgtaatccggtccgctccttattcagccgccgggaactgcgaggaggcgtcatgtagcagcagcagcaaatccgcctcgcatttgcaactcttttttttttttttggtggggcggggggcgcgcggcaaaattctgtctccgcccccccttttcttgcccacttccatttgcaagctgcatctgcctctctaaaaaaattgaggagttcggggaagggcagggggccataaatcagagttggacctgcaataacccccacacctacagggcaaccatgaccgaggagagctctgacgttcccagggagttgatagaaagcataaaggatgttattggcagaaagataaaaatttcagtgaagaagaaagtaaagttggaagttaagggagacaaagttgaaaacaaagtgctggtccttacatcatgccgagccttccttgtaacagcgcgaatccccaccaagctcgagttaaccttcagctacttggagattcatggcgtcgtttgcagcaagtcagctcagatgattgtggaaactgagaagtgcagcatttccatgaagatggcgtcacccgaggacgtgagtgaggtgctggctcacataggcacctgcctgaggaagatatttcctggcctctctccagtgagaatcatgaaaaaagtctccatggagccatctgagcgcctggctagtctccaggcgctgtgggacagccagaccgtggctgagcagggcccctgtggtggattttctcagatgtatgcctgtgtttgtgactggcttggattttcatacagggaagaagtacaatgggatgtggatacaatttatcttacccaagacaccagggaattgaatttacaagattttagtcatcttgaccacagggacctaatacctatcattgctgctctggaatataatcagtggttcacaaaactgtcctctaaggatctaaaactgtccactgatgtctgtgaacagatcttgagggtggtgagtaggtccaatcgactggaagaattggtgttggaaaatgctggacttagaacagattttgcacaaaaactggccagtgctctagcacataatcccaactcaggactccacacaattaaccttgctggcaacccactggaggatagaggtgtgtcctctttaagtattcaatttgccaaactcccaaagggattaaagcacttaaatttatctaaaacctcattatcacctaaaggggtgaacagcctttctcagtcactcagtgccaatccattgaccgcctctacccttgtccacctcgacctctcagggaacgtccttcgtggagatgacctctcacacatgtataattttttggcccagccaaatgccattgttcatctggatttatccaatacagaatgttccctggacatggtctgtggagctcttctccgtggatgccttcaatatttagctgtgctcaacctctccagaactgtcttctctcaccggaaaggaaaagaagtacctccatctttcaagcaattttttagtagttctctggctttgatgcacatcaacctttcaggcacaaaactgtctcctgagcccttaaaagcactgttattgggcctggcttgtaatcataacttgaaaggggtttctctggatctcagcaactgtgagctgagatcaggaggtgctcaagtattagaaggttgcattgctgaaatacacaacatcaccagcttagacatctctgacaatggtttagaatctgacctatctaccttaatagtgtggctcagtaaaaacagatcaatacaacacctggcgttaggcaaaaattttaataatatgaaatccaaaaatctgacacctgtattggacaacttagtacagatgattcaagatgaagaatcacctctgcagtccttgtccctggctgactcgaaactcaagactgaggtcaccatcatcatcaatgccctgggaagcaacacctccctgaccaaagtggacattagcggcaacggaatgggggacatgggagcgaagatgctggccaaagcactgcagatcaacactaagctcaggactgtaatatgggacaagaacaacatcactgcacaaggctttcaggatatagctgttgctatggaaaagaactacacattaagatttatgccaattcctatgtatgatgcttctcaagccctaaaaacaaaccctgaaaaaacagaagacgctctgcaaaagatagaaaactacctgctacgaaatcacgagactagaaaataccttcaagagcaggcctaccgcctgcagcagggtattgtcaccagcaccacccagcagatgattgacagaatatgtgtgaaagtacaagatcatctcaactccttacgaaattgtgggggagacgctatccaggaagatttaaaatcagcagagcggctcatgcgtgatgctaagaactctaaaacgttgttaccaaatttataccatgttggtggtgcatcttgggcgggagccagtggcttactatccagtccaattcaggagaccctggaatcaatggctggagaagttacaagagtagtagatgaacaactaaaggcgttgcttgagtccatggttgatgctgctgagaatctttgtcccaatgtgatgaaaaaagcccacattcgacaagacttgattcatgccagcaccgaaaagatttctattccacgtacctttgttaaaaatgtcctgttggagcagtctggaattgatatccttaacaaaattagtgaagtaaaattgacagtggcctcgttcctgtctgatagaattgtggatgaaatcctggatgcactctcacattgccatcataaactggctgaccatttcagcagacgtggcaagacccttcctcaacaagaatccttagagatcgagctggctgaggagaagccagttaaacgttccatcatcacagtggaggagctaacagagatagagcgtttggaagatctggatacctgtatgatgacccctaaatccaaaaggaagagtatccatagccgaatgctgcggcctgtttctagggcttttgaaatggagtttgatctagataaagcgctggaagaggtaccaattcacatcgaagacccgcccttcccatccctcagacaggagaagcggagctcgggatttatctctgagttgccctctgaagaggggaagaagctggaacactttaccaagttaaggccaaaaaggaataagaagcagcaacccacccaagcagcggtctgtgctgccaacatagtctcacaagatggtgaacagaatggtctcatggggagagtggatgaaggtgtagatgaattttttaccaagaaggtgaccaaaatggattccaagaaatggtcaacaagaggctcagagtcccatgagcttaatgaaggaggagatgaaaagaaaaagcgagattctcggaaaagtagtggctttctcaatttaatcaaatcccggtccaaatccgagcgaccaccaacgatcttgatgacagaagaaccctcctcaccaaaaggggcagtcagaagtccacctgtggactgtcccaggaaggacacaaaggccgccgagcacaatggcaattctgaacggatagaggagataaaaacacctgactcctttgaagagagtcaaggggaagaaatagggaaggtggaacggagtgacagcaagagcagcccacaggcagggcggaggtatggggtccaggtgatgggcagtggtctgctggcagagatgaaagccaagcaagagaagagagctgcgtgtgcgcagaagaagcttgggaatgatgccgtatcccaggattcttccagcccagctttgagcggcgtagaacggtcggatggaggtggggcagtgcctaaactgcacccaggtcttccagagaaccgctttggtttgggaacaccagaaaagaataccaaagcagaacccaaagcggaagcaggctccaggtctcggagctcatccagcacacctacgagcccgaagcccctcctgcagtcccccaaacccagtctggcagcacggcccgtcatcccgcagaaaccaagaaccgcctcacggcctgatgacattccagactctccatctagcccgaaagttgcccttcttccacctgtcctgaaaaaagttccttcagacaaagagagagatggccagagtagcccccagcccagccccaggacattttcacaggaagtttcaaggagaagctggggccagcaggcccaggagtatcaagaacaaaagcaacggtcctccagtaaagatggccatcaaggcagcaaatctaatgactccggggaagaagcagaaaaagagtttatttttgtgtaaaggtcacccacgcagaagtcttcctgtgcagggtgctttggtagccatcagagaggaaccaagggcaacatcttttcttcccaggcgttcttctctgggtgctttattctcttctttttctttatttcgcccccacccccatcccctgccttttttttttttttttttttttttttttgtatagaaacagatccatttcttggtaatcaaagcacatttgtttggtcttcctccaaccctttgcatttgatttctaaacattccttcatatgcctttaatgaaagccagcaattatcccatgggccctacttgaatttatctgaggcagctacagattgccctgcaagatgagtttttggagataaatgaaataactggacacacactcacacaagtaacaccacagcagacctcggagtactgctaagtgtacctgtgtcaaatccgcacaggactcaatatagcaatttattcttgatgtatgcaattgcacattgtaattatattaacagagcacactaataatttgtatagattatatatattagatcttgggtatggtttttaccttctcccatggggaacttcttccttcctgatgtggaattgtacatttaaagcttggtcggtgacctttgcataccatcaacgagcacagctaagaacagagtgagagaggcccatggctgattttaccatgtgcccagattaatgtatatagttgattggaatgaggttttatgaatattcatgtttttgaaggcctttaatttctgtctgcatattagcttttaatgtgtgattttaagagagaatactttgacacctgtaaaaatcaaaatactactctttataagacatttcacaaatattcacttacattacaggctggaagtattttattcatatgtatatttataccaataaaatgattttacaagtggaa

SEQ ID NO: 147960 - DNA, 3201 bp, Homo sapiens
  Payload ID: 9279
  Gene Symbol: LRRC16A
  Gene Name: leucine rich repeat containing 16A
  ENST ID: ENST00000635618
  CDS Start-End: 1-2799
gaagtacctccatctttcaagcaattttttagtagttctctggctttgatgcacatcaacctttcaggcacaaaactgtctcctgagcccttaaaagcactgttattgggcctggcttgtaatcataacttgaaaggggtttctctggatctcagcaactgtgagcttggccattgtctgagatcaggaggtgctcaagtattagaaggttgcattgctgaaatacacaacatcaccagcttagacatctctgacaatggtttagaatctgacctatctaccttaatagtgtggctcagtaaaaacagatcaatacaacacctggcgttaggcaaaaattttaataatatgaaatccaaaaatctgacacctgtattggacaacttagtacagatgattcaagatgaagaatcacctctgcagtccttgtccctggctgactcgaaactcaagactgaggtcaccatcatcatcaatgccctgggaagcaacacctccctgaccaaagtggacattagcggcaacggaatgggggacatgggagcgaagatgctggccaaagcactgcagatcaacactaagctcaggactgtaatatgggacaagaacaacatcactgcacaaggctttcaggatatagctgttgctatggaaaagaactacacattaagatttatgccaattcctatgtatgatgcttctcaagccctaaaaacaaaccctgaaaaaacagaagacgctctgcaaaagatagaaaactacctgctacgaaatcacgagactagaaaataccttcaagagcaggcctaccgcctgcagcagggtattgtcaccagcaccacccagcagatgattgacagaatatgtgtgaaagtacaagatcatctcaactccttacgaaattgtgggggagacgctatccaggaagatttaaaatcagcagagcggctcatgcgtgatgctaagaactctaaaacgttgttaccaaatttataccatgttggtggtgcatcttgggcgggagccagtggcttactatccagtccaattcaggagaccctggaatcaatggctggagaagttacaagagtagtagatgaacaactaaaggcgttgcttgagtccatggttgatgctgctgagaatctttgtcccaatgtgatgaaaaaagcccacattcgacaagacttgattcatgccagcaccgaaaagatttctattccacgtacctttgttaaaaatgtcctgttggagcagtctggaattgatatccttaacaaaattagtgaagtaaaattgacagtggcctcgttcctgtctgatagaattgtggatgaaatcctggatgcactctcacattgccatcataaactggctgaccatttcagcagacgtggcaagacccttcctcaacaagaatccttagagatcgagctggctgaggagaagccagttaaacgttccatcatcacagtggaggagctaacagagatagagcgtttggaagatctggatacctgtatgactctctgctgtacaagtatgacccctaaatccaaaaggaagagtatccatagccgaatgctgcggcctgtttctagggcttttgaaatggagtttgatctagataaagcgctggaagaggtaccaattcacatcgaagacccgcccttcccatccctcagacaggagaagcggagctcgggatttatctctgagttgccctctgaagaggggaagaagctggaacactttaccaagttaaggccaaaaaggaataagaagcagcaacccacccaagcagcggtctgtgctgccaacatagtctcacaagatggtgaacagaatggtctcatggggagagtggatgaaggtgtagatgaattttttaccaagaaggtgaccaaaatggattccaagaaatggtcaacaagaggctcagagtcccatgagcttaatgaaggaggagatgaaaagaaaaagcgagattctcggaaaagtagtggctttctcaatttaatcaaatcccggtccaaatccgagcgaccaccaacgatcttgatgacagaagaaccctcctcaccaaaaggggcagtcagaagtccacctgtggactgtcccaggaaggacacaaaggccgccgagcacaatggcaattctgaacggatagaggagataaaaacacctgactcctttgaagagagtcaaggggaagaaatagggaaggtggaacggagtgacagcaagagcagcccacaggcagggcggaggtatggggtccaggtgatgggcagtggtctgctggcagagatgaaagccaagcaagagaagagagctgcgtgtgcgcagaagaagcttgggaatgatgccgtatcccaggattcttccagcccagctttgagcggcgtagaacggtcggatggaggtggggcagtgcctaaactgcacccaggtcttccagagaaccgctttggtttgggaacaccagaaaagaataccaaagcagaacccaaagcggaagcaggctccaggtctcggagctcatccagcacacctacgagcccgaagcccctcctgcagtcccccaaacccagtctggcagcacggcccgtcatcccgcagaaaccaagaaccgcctcacggcctgatgacattccagactctccatctagcccgaaagttgcccttcttccacctgtcctgaaaaaagttccttcagacaaagagagagatggccagagtagcccccagcccagccccaggacattttcacaggaagcatgcccaactaatttctgaaacagtagtgcaaagaggagattattacaaaagacattcagatcatgacagtggcaagccttccagtagagggaaaagatcttcaaaactgtactccaccattgcagaagaggaagtgaatgcaattgggcacaggaagtcacagccaacaaatgtttcaaggagaagctggggccagcaggcccaggagtatcaagaacaaaagcaacggtcctccagtaaagatggccatcaaggcagcaaatctaatgactccggggaagaagcagaaaaagagtttatttttgtgtaaaggtcacccacgcagaagtcttcctgtgcagggtgctttggtagccatcagagaggaaccaagggcaacatcttttcttcccaggcgttcttctctgggtgctttattct

SEQ ID NO: 147961 - DNA, 1290 bp, Homo sapiens
  Payload ID: 9279
  Gene Symbol: LRRC16A
  Gene Name: leucine rich repeat containing 16A
  ENST ID: ENST00000461945
  CDS Start-End: 372-962
ttttgcggtttgggagggaggctgcgaggaggggcgcggtgcccgccgccgccaccgcagcaccgcacagcgtctctcctgggggtgcgacctacgccggggacccagcgctcgggcaccggaggccggcctcgcaccggtgcggaggccggctctcgcgagaaagcataaaggatgttattggcagaaagataaaaatttcagtgaagaagaaagtaaagttggaagttaagggagacaaagttgaaaacaaagtgctggtccttacatcatgccgagccttccttgtaacagcgcgaatccccaccaagctcgagttaaccttcagctacttggagattcatggcgtcgtttgcagcaagtcagctcagatgattgtggaaactgagaagtgcagcatttccatgaagatggcgtcacccgaggacgtgagtgaggtgctggctcacataggcacctgcctgaggaagatatttcctggcctctctccagtgagaatcatgaaaaaagtctccatggagccatctgagcgcctggctagtctccaggcgctgtgggacagccagaccgtggctgagcagggcccctgtggtggattttctcagatgtatgcctgtgtttgtgactggcttggattttcatacagggaagaagtacaatgggatgtggatacaatttatcttacccaagacaccagggaattgaatttacaagattttagtcatcttgaccacaggaaatccagaattgcagtgtggtccctgaagagctctagccaactgaatcggccagggaaaaagtatactagctggatatacctcctctttgcacagcctgggactacggaagatggtgaagcaggctcagctgtgtctgtagttgtggctgatgggcctaaagcctccagttctcaggcaattttttttttttcctgcttagagcagttctccttcttcctataagtgaggcaactttatactttcaaatttagacaagatgtttcctgtgtagctcataaaaaagtgaactgagaaagaaaaagggaaaatattttactttgtaagtattttccaataaaacaagaaaattgcacgtggaataagatagaagtttacagtcctccagtgtttggtctcagcgtttttggtccctttacaatcttaaaaatgatcgatctttggtttttgtgggtcaaaacattggtatttacaatattataaattaaaactaaaatttgaaatatttattaattaaaaagtgacactaataaagcaaaccattacgtactaa

SEQ ID NO: 147962 - DNA, 4597 bp, Homo sapiens
  Payload ID: 9280
  Gene Symbol: LRRC16B
  Gene Name: leucine rich repeat containing 16B
  Uniprot ID: Q8ND23
  ENST ID: ENST00000342740
  CDS Start-End: 155-4273
ggagcgctcaagcagccgcccctgaccggagcgggctcggccgctgctgcagcgctcagcgcccgggccctgctgaagccgggtctagcatgtgccgcggctccccggcggcggcggcggctcctctgcagcagcctcagcagcagcggccgccatggccaagcccagcgtggagctcacccgcgagttgcaagacagcatccggaggtgcctgagccaaggggccgtgctccaacaacatcatgtgaagttggagacaaagcccaagaagtttgaggaccgagtgctggccctgacctcctggcgcctccacctcttcctccttaaagtcccggccaaggtggagagctccttcaatgtcctggagatccgtgccttcaacacgctcagtcagaatcagatcctggtggagacggagcgtggcatggtgagcatgcgactgccatcagctgaaagtgtggaccaggtgacacgacatgtgagctctgccctgtccaaggtctgccctggccctgggtgtttgatccggcgtggaaacgcagacaccccagaggggccccgagatacatcccccaactctgagacttccacatctaccacccacagtgtctgcggtggcttctctgagacctacgctgctctgtgtgactacaatgggctacactgccgtgaggaggttcaatgggatgtggacaccatctaccatgctgaagataaccgggagttcaatcttttggatttcagccacttggagagccgagacttggccctaatggtagcagccctggcctacaaccagtggttcaccaaactctactgcaaggacttgcggctgggctctgaagtgctagaacaggtgctacataccctaagcaagtcggggagcctcgaagagctggtgctggacaacgccgggcttaagacggactttgtccagaagctggccggggtgtttggggagaacgggagctgtgtgctgcatgccctcactctgtcccacaaccccatcgaggacaagggttttctcagtctgagccagcagctcctctgcttcccctctggcctcaccaaactgtgcctggccaagactgccatttcccctcgagggctccaggcactcggccagaccttcggggcaaacccagcatttgccagctcccttcgatacctggacctgagcaagaatcctgggctcctcgccacggatgaggccaatgccctctacagtttcctggcccaacccaacgccctggtgcacctggacctgtcaggaactgactgcgtcatcgacttgcttctcggtgccctgctccacggctgctgctcccacctcacctacctcaacctggctcgcaacagctgctcccacaggaagggtcgagaggccccgccggccttcaagcagttcttcagcagcgcctacacactgagccacgtcaatctgtcggccacaaagctgcccctggaggccctcagggcgctgcttcagggcctctccctcaacagtcacctcagtgacctgcacctggatctcagcagctgcgagctccgttcagcgggagcccaagccttgcaggagcagctgggagctgtcacctgtgtaggcagcctggatctgtcagacaatgggttcgactcggacctcctgacactggtgcctgcacttggcaagaacaagtccctcaagcacctgtttttgggcaagaacttcaatgtcaaggccaagaccctggaggagatcctccacaagctggtgcagctgatccaggaagaggactgttccctgcagtcactgtcggtggcagactcccggctgaagcttcgcaccagcatcctcatcaatgccctgggcagcaacacctgcctggccaaggtggatctgagcggcaatggcatggaggacatcggggccaagatgctgtctaaggccctgcagataaactcctccctcagaactatcctatgggatcggaacaatacatctgccctgggcttcctggacatcgcaagggccctggagagcaaccacacgctgcgcttcatgtccttccccgtgagcgacatctcccaagcctatcgcagcgcgcctgagcgcaccgaggacgtctggcagaagatccaatggtgcttagtgaggaacaaccactcccagacgtgcccccaggagcaggccttcaggttgcagcagggcctggtgaccagcagcgccgagcaaatgctgcagcggctgtgtggacgagtgcaggaggaggtgcgggccctgagactatgccccctggagcctgtgcaggatgagctactctacgctcgggacctcatcaaagatgccaagaactcccgggcgctgtttcccagcctctatgagctgggccacgtgctggccaatgatgggcctgtgcggcagaggctggaatcagtagcaagtgaggtgtccaaagctgtggacaaggagctgcaggtgatcctggagtccatggtcagcctgacacaggagttatgccctgtggccatgcgggtggccgagggacacaacaagatgctgagcaatgtggcggagcgtgtcactgtgccccggaacttcatccgaggggcactgctggagcaagcaggacaggacattcagaacaagctggatgaagtgaagctctcagtcgtcacctacctaaccagctccatagtggatgagatcctgcaagagctctaccattcccacaagagcctggcccggcacctgacccagctaaggacgctgtcagatccaccagggtgcccaggccaagggcaggatctgtcctcccggggccgaggccggaaccatgaccatgaggagaccacagatgatgaacttgggaccaacattgacaccatggccatcaaaaagcagaaacgctgccgcaagattcggccggtgtctgccttcatcagcgggagccctcaggacatggaaagccaactggggaatctggggatcccccctggctggttctcaggacttgggggcagccagcccacagctagtggctcctgggaaggtctatctgagctgcccactcatggttacaaactaaggcatcaaacacaagggaggccccgcccccccaggaccacacctccaggacctggtcgacccagtatgccagcacctgggactcgtcaggagaatgggatggccacccgcctggatgaagggctggaggacttcttcagccgaagggtcctggaggaaagttctagctacccccggactctgaggaccgtgcggccaggactctcggaggcaccgctgcctccactccagaagaagaggcgccggggcctgtttcactttcgccggccccggagcttcaagggggacagggggccggggtcccctaccactggactcctcctccctccacccccaccccctcccccgactcaggagagcccccctagcccagaccccccaagcctcggcaataactcctctccctgctggagcccagaggaggagagcagcctcctccctggatttggtgggggccggggaccttccttccgccggaagatgggcactgaggggtcagagccaggggaggggggcccagcccctgggacagcacagcagccaagggttcacggtgttgcccttcccgggttggaaagagccaagggttggagcttcgatgggaaacgagagggcccaggcccagaccaggagggcagcacccaggcctggcagaaacggcgctcttcagacgacgcagggcctggatcctggaagcccccaccaccgccccaaagcaccaaaccaagcttcagcgccatgcgcagagcagaggccacatggcacatagctgaagagagtgcccccaaccacagctgccagagtcccagcccagcctcccaagatggggaagaggagaaggaggggaccctcttcccagagaggacacttccagctaggaatgccaagctacaggaccccgctctagctccatggcctcccaagccagtggctgtgcccaggggccgccagcctccccaggagccaggggtcagggaggaggctgaggctggagatgcagctccaggagtcaacaaaccccggctgaggctgagctcacagcaagaccaagaggagcccgaagtccaagggccccctgatccaggccggcggactgcccccctgaagcccaagaggacacggcgggcacagtcctgtgacaagctggaacctgatagaagacggcctcctgaccccacaggaaccagtgagccaggaacagactgacaactgccacaacaccctcctcagccctcgacatgtgcctcgcaaggactcagacccctatccacccccagtccccagggccccctgccagcccctgtcctacaggggcaagacggcaggaccaggcatgggggagctggaggcagggactagaacagagggagccacctggagagacggaggctgtcagtgcctgcctcgatacctctctctgcagagagcttctgggtgggggcttatctcctcccccaggagggtggatctctgtccctctatccccagggactctctcccctcttgtatagaataaaaaaacaaaatcat

SEQ ID NO: 147963 - DNA, 2002 bp, Homo sapiens
  Payload ID: 9281
  Gene Symbol: LRRC17
  Gene Name: leucine rich repeat containing 17
  Uniprot ID: Q8N6Y2
  ENST ID: ENST00000249377
  CDS Start-End: 282-1223
tataacgtgagggctgaatgcagcccattctctggagaacttcctcacacaccgcagcaaagagaagactgaaagacaaacctgggtgcagccagagaggtccagatagatgagcttgtggcatccattccccaagttcagcctagggactccacgtaccccagctgggtctcattgttccagaactgcattagttaagattacccagacttggatttcaaaggaatactttcattgttccgtctgtaacacgaagtaattggggccagctggatgtcaggatgcgtgtggttaccattgtaatcttgctctgcttttgcaaagcggctgagctgcgcaaagcaagcccaggcagtgtgagaagccgagtgaatcatggccgggcgggtggaggccggagaggctccaacccggtcaaacgctacgcaccaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagtttaaaaagctgaaaagcctggatctgcagcagaatgagatctctaaaattgagagtgaggcgttctttggtttaaacaaactcaccaccctcttactgcagcacaaccagatcaaagtcttgacggaggaagtgttcatttacacacctctcttgagctacctgcgtctttatgacaacccctggcactgtacttgtgagatagaaacgcttatttcaatgttgcagattcccaggaaccggaatttggggaactacgccaagtgtgaaagtccacaagaacaaaaaaataaaaaactgcggcagataaaatctgaacagttgtgtaatgaagaagaaaaggaacaattggacccgaaaccccaagtgtcagggagacccccagtcatcaagcctgaggtggactcaactttttgccacaattatgtgtttcccatacaaacactggactgcaaaaggaaagagttgaaaaaagtgccaaacaacatccctccagatattgttaaacttgacttgtcatacaataaaatcaaccaacttcgacccaaggaatttgaagatgttcatgagctgaagaaattaaacctcagcagcaatggcattgaattcatcgatcctgggtctttgagatgaaaccctgcaagtagacttacgtgaatgatttttgctgtgccgcttttttagggctcacacatttagaagaattagatttatcaaacaacagtctgcaaaactttgactatggcgtattagaagacttgtattttttgaaactcttgtggctcagagataacccttggagatgtgactacaacattcactacctctactactggttaaagcaccactacaatgtccattttaatggcctggaatgcaaaacgcctgaagaatacaaaggatggtctgtgggaaaatatattagaagttactatgaagaatgccccaaagacaagttaccagcatatcctgagtcatttgaccaagacacagaagatgatgaatgggaaaaaaaacatagagatcacaccgcaaagaagcaaagcgtaataattactatagtaggataaggtagaaattgttctgattgtaattagttttgtattttctatactggtgttagaaaacatatgtttacatttgattaactgtgttgcctatttatgcagggtaatccagctaaaggaagctttctttaattataagtattattgtgactattatagtaatcaagagaatgctatcatcctgcttgcctgtccatttgtggaacagcatctggtgatatgcaattccacactggtaacctgcagcagttgggtcctaatgatggcattagactttcataatgtcctgtataaatgtttttactgcttttagaaaataaagaaaaaaaacttggttcatgttta

SEQ ID NO: 147964 - DNA, 1963 bp, Homo sapiens
  Payload ID: 9281
  Gene Symbol: LRRC17
  Gene Name: leucine rich repeat containing 17
  Uniprot ID: Q8N6Y2
  ENST ID: ENST00000339431
  CDS Start-End: 296-1621
gtgcacagcattagtataacgtgagggctgaatgcagcccattctctggagaacttcctcacacaccgcagcaaagagaagactgaaagacaaacctgggtgcagccagagaggtccagatagatgagcttgtggcatccattccccaagttcagcctagggactccacgtaccccagctgggtctcattgttccagaactgcattagttaagattacccagacttggatttcaaaggaatactttcattgttccgtctgtaacacgaagtaattggggccagctggatgtcaggatgcgtgtggttaccattgtaatcttgctctgcttttgcaaagcggctgagctgcgcaaagcaagcccaggcagtgtgagaagccgagtgaatcatggccgggcgggtggaggccggagaggctccaacccggtcaaacgctacgcaccaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagtttaaaaagctgaaaagcctggatctgcagcagaatgagatctctaaaattgagagtgaggcgttctttggtttaaacaaactcaccaccctcttactgcagcacaaccagatcaaagtcttgacggaggaagtgttcatttacacacctctcttgagctacctgcgtctttatgacaacccctggcactgtacttgtgagatagaaacgcttatttcaatgttgcagattcccaggaaccggaatttggggaactacgccaagtgtgaaagtccacaagaacaaaaaaataaaaaactgcggcagataaaatctgaacagttgtgtaatgaagaagaaaaggaacaattggacccgaaaccccaagtgtcagggagacccccagtcatcaagcctgaggtggactcaactttttgccacaattatgtgtttcccatacaaacactggactgcaaaaggaaagagttgaaaaaagtgccaaacaacatccctccagatattgttaaacttgacttgtcatacaataaaatcaaccaacttcgacccaaggaatttgaagatgttcatgagctgaagaaattaaacctcagcagcaatggcattgaattcatcgatcctgccgcttttttagggctcacacatttagaagaattagatttatcaaacaacagtctgcaaaactttgactatggcgtattagaagacttgtattttttgaaactcttgtggctcagagataacccttggagatgtgactacaacattcactacctctactactggttaaagcaccactacaatgtccattttaatggcctggaatgcaaaacgcctgaagaatacaaaggatggtctgtgggaaaatatattagaagttactatgaagaatgccccaaagacaagttaccagcatatcctgagtcatttgaccaagacacagaagatgatgaatgggaaaaaaaacatagagatcacaccgcaaagaagcaaagcgtaataattactatagtaggataaggtagaaattgttctgattgtaattagttttgtattttctatactggtgttagaaaacatatgtttacatttgattaactgtgttgcctatttatgcagggtaatccagctaaaggaagctttctttaattataagtattattgtgactattatagtaatcaagagaatgctatcatcctgcttgcctgtccatttgtggaacagcatctggtgatatgcaattccacactggtaacctgcagcagttgggtcctaatgatggcattagactttcataatgtcctgtataaatgtttttactgcttttagaaaataaagaaaaaaaacttggttcatgttta

SEQ ID NO: 147965 - DNA, 801 bp, Homo sapiens
  Payload ID: 9281
  Gene Symbol: LRRC17
  Gene Name: leucine rich repeat containing 17
  ENST ID: ENST00000455453
  CDS Start-End: 489-801
tctggagcccacacccaacatggttggtgactgggagacagaaaaggatagaaaaaaaaaaggctcaggaagacaacaattcaagtcctacccttgtgtgtgcatctcaaggctgtgttcttttaaagaaggagaattctttgaatttcttaaatccgatgtgatggtgaactgcaggcttcggttttcatcatgctgagtcctaacatttgtgactacttcccccggggtggccatgtgaagcatcttatgcgcatgagcctattttatcctcccaacaatattaggaggtatcctcggtccgttttacagatgctgaagatgacccaggttgatacagttaagcagcctagggactccacgtaccccagctgggtctcattgttccagaactgcattagttaagattacccagacttggatttcaaaggaatactttcattgttccgtctgtaacacgaagtaattggggccagctggatgtcaggatgcgtgtggttaccattgtaatcttgctctgcttttgcaaagcggctgagctgcgcaaagcaagcccaggcagtgtgagaagccgagtgaatcatggccgggcgggtggaggccggagaggctccaacccggtcaaacgctacgcaccaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagttta

SEQ ID NO: 147966 - DNA, 1626 bp, Homo sapiens
  Payload ID: 9282
  Gene Symbol: LRRC18
  Gene Name: leucine rich repeat containing 18
  Uniprot ID: Q8N456
  ENST ID: ENST00000298124
  CDS Start-End: 92-877
ctgggactagcaggtttttcatgatttttcctcacactgatcactatccaatcagaacaataaacttctaacactcccttactaaaagaacatggttaagggtgagaaaggccccaagggcaagaagatcaccctcaaggtggccaggaattgcatcaaaatcacttttgatgggaaaaagcgccttgacttgagcaagatgggaattaccaccttccccaagtgtattctgcgccttagtgacatggacgagctggaccttagccggaatcttatcaggaagatccctgactccatctccaagttccagaacctccggtggctggacctgcacagcaactacatagacaagctgcctgagtccattggccagatgaccagcctgctctacctcaacgtcagcaacaaccggctgaccagcaacgggctgcccgtggagctgaagcaactcaagaacatccgcgctgtgaacctaggcttgaaccacctggacagcgtgcccaccacactgggggccctgaaggagctccacgaggtagggctccatgacaacctactgaacaacatccccgtgagcatctccaagctccccaagctgaaaaagctcaacataaagcggaacccctttccaaagccaggtgagtcggaaatattcatagactccatcaggaggctggagaacttgtatgttgtggaggagaaggatctgtgtgcggcttgcctgagaaaatgccaaaacgcccgggacaacctgaatagaatcaagaacatggccacgacgacaccgagaaagaccatctttcccaatctgatctcacccaattccatggccaaggactcctgggaagactggagaatacgcttgacatcttcctagagtagctgtggcaaaatcttgaagactactcagctaacagaataaacgactctgaagaggagaagcccccagttaggagaagacagagtggcaagtgagatgttctggaaaccaggctcgccggagctggccaagccaccgacttgcttctcaaattcacttcacctcccttagctttagcccacctgtgtgtgaaaatgactttgggaaatatttgatgtggtttttaaaatgtatatagaaaaaaatttaagaaaattacagattatatattatagacaactaaatatttaagactttaagacttaaaaggcttactgcctctacatttcactcagactagtacatctcaatgccagtagtctgtgataaatttatgtaggtataatgagatactgatatggtttgggcatttgtctcctccaaacctcatgttgagatttgatccccagtgttggaggtggggcctaatggaaggtcatgggggtgggtccctcatgaatggcctggtgccatccttttggtaatgagtgagttctcactgtattagatcctgttgaaaattgattgttaaaaagaccttggcacctccctctcctctctctctcttcctctcactatgtgatgcctgctccccttcaccttccaccatgagtggaagcacctataccccaaagccctcaccagaaggaggtgccggcacctgtacagcttgtaagaaccatgactcaaataaacttcttttcttt

SEQ ID NO: 147967 - DNA, 1617 bp, Homo sapiens
  Payload ID: 9282
  Gene Symbol: LRRC18
  Gene Name: leucine rich repeat containing 18
  Uniprot ID: Q8N456
  ENST ID: ENST00000374160
  CDS Start-End: 78-863
tttttcatgatttttcctcacactgatcactatccaatcagaacaataaacttctaacactcccttactaaaagaacatggttaagggtgagaaaggccccaagggcaagaagatcaccctcaaggtggccaggaattgcatcaaaatcacttttgatgggaaaaagcgccttgacttgagcaagatgggaattaccaccttccccaagtgtattctgcgccttagtgacatggacgagctggaccttagccggaatcttatcaggaagatccctgactccatctccaagttccagaacctccggtggctggacctgcacagcaactacatagacaagctgcctgagtccattggccagatgaccagcctgctctacctcaacgtcagcaacaaccggctgaccagcaacgggctgcccgtggagctgaagcaactcaagaacatccgcgctgtgaacctaggcttgaaccacctggacagcgtgcccaccacactgggggccctgaaggagctccacgaggtagggctccatgacaacctactgaacaacatccccgtgagcatctccaagctccccaagctgaaaaagctcaacataaagcggaacccctttccaaagccaggtgagtcggaaatattcatagactccatcaggaggctggagaacttgtatgttgtggaggagaaggatctgtgtgcggcttgcctgagaaaatgccaaaacgcccgggacaacctgaatagaatcaagaacatggccacgacgacaccgagaaagaccatctttcccaatctgatctcacccaattccatggccaaggactcctgggaagactggagaatacgcttgacatcttcctagagtagctgtggcaaaatcttgaagactactcagctaacagaataaacgactctgaagaggagaagcccccagttaggagaagacagagtggcaagtgagatgttctggaaaccaggctcgccggagctggccaagccaccgacttgcttctcaaattcacttcacctcccttagctttagcccacctgtgtgtgaaaatgactttgggaaatatttgatgtggtttttaaaatgtatatagaaaaaaatttaagaaaattacagattatatattatagacaactaaatatttaagactttaagacttaaaaggcttactgcctctacatttcactcagactagtacatctcaatgccagtagtctgtgataaatttatgtaggtataatgagatactgatatggtttgggcatttgtctcctccaaacctcatgttgagatttgatccccagtgttggaggtggggcctaatggaaggtcatgggggtgggtccctcatgaatggcctggtgccatccttttggtaatgagtgagttctcactgtattagatcctgttgaaaattgattgttaaaaagaccttggcacctccctctcctctctctctcttcctctcactatgtgatgcctgctccccttcaccttccaccatgagtggaagcacctataccccaaagccctcaccagaaggaggtgccggcacctgtacagcttgtaagaaccatgactcaaataaacttcttttctttataaa

SEQ ID NO: 147968 - DNA, 3609 bp, Homo sapiens
  Payload ID: 9283
  Gene Symbol: LRRC19
  Gene Name: leucine rich repeat containing 19
  Uniprot ID: Q9H756
  ENST ID: ENST00000380055
  CDS Start-End: 112-1224
aaaacaaagtgaaatgtaatcatacgatgtactttttttaatgccgttgaaacagagttaatttcctttagcacacaagtcttagagacaaaagaaaaaaaggtctgcaacatgaaagtcacaggcatcacaatcctcttttggcccctctccatgatattattatcagacaaaatccagtcttctaaaagagaagtccaatgtaattttactgaaaaaaattataccttgattccagcagatatcaagaaagatgttactatacttgatctcagttataaccaaattactcttaatggtacagacacaagagttctacagacatactttttactcacagagctctatttgattgagaacaaggttactatcttacataataacggttttggtaacctctccagtctagaaattttaaatatctgtagaaactccatctatgtaattcaacagggtgcatttttaggcttaaataaactaaaacagttatatctctgccaaaacaaaatagaacaactgaatgctgatgtatttgtgcctctaagaagcctaaaacttctgaatctgcaaggcaatttgattagctatttggatgtaccaccactatttcatctggaattaataactttatatggaaacctatggaactgctcttgcagtctatttaatttgcagaactggttgaacacatcaaatgtgacattagaaaatgagaacatcaccatgtgtagctaccccaacagcctgcagagctacaatatcaaaacagtacctcataaggctgaatgccactcaaaatttccttcatcagtaactgaagatctttatattcattttcagcccatcagcaattcaatatttaatagctcttcgaacaacttaacaagaaattcagaacatgaacctcttggaaaaagttgggcttttcttgttggtgttgttgtcactgtactgacgacttcacttctcatttttattgctatcaaatgcccaatatggtacaatattctgcttagttataatcatcatcgcctggaagagcatgaagcagaaacctatgaagatggttttactggaaatccaagctctctttcacagataccagaaacaaactctgaagaaactacagtaatatttgaacaattacattcatttgtggtagatgatgatggatttattgaagacaaatatatagatatccatgaattatgtgaagaaaattaatttctttcaaagtttgctttttaaagcaaagttatcagctcactcagtttagatatggagattttgctatgtgacataacaaaatacagctggcaggcattcatattaatgacaacatacatgaatatcataaaattatgttctttgcattatattgagcaagcaggttcaaatacagtaactgacactcctcggtagttgacagttacatagtctacaatactagcactactattcttagcagtgcttgggtgaccatacgaactagtaaaaaggtctaaattattcatgaattaaaatgaatggattctcatattaacacaggtatttgacataatatgtattaagttatactaatgtttcaatcagtaaagaaataaaagtttaggatttattaatatatggaagtcaaagtgaggaacagagatagcttaaataatacactaagattgattttatgctcccagaataaaatcatagagttggaaaatatttttttgaaatgcttcctgaaatagcacaataaatttccttaaaatttcatagcaatttaaagcacaagcacaatgttcaggcataatccctaataagtcactattgattctggttataaagaaaggctgtcaccataatgcaggatcactacagtttaatgtcatactggcttccaaagtgggcatcacaattatctataaatcttgttttaaaaatacatatttccacctctctctgggagatttttattcaaattggtctgtgctgacactaaggaatcttcatgtggtccatggacagctatttctatctattcagtagatagagcaatgtttcccaaattgtttttctagaatactaatttccagagagacattcacaagtatttacagaagaagaaggaggtacatggtcaaattactacaggaaaaactagtagtttaaacaaggtgaaacaagattctttttcttttttttttttttttttttgagacaaagtctcgcactgtctcccaggctggactgcagcagcgcagtctcagatcactgcaacctccgcctcctgggttcaagcaattcttctgactcagcctcccgagtagctgggagtacaggtgcacaccaccatgcctggctaatttctgtatttttagtagagacagggtttcaccatgttggccaggctggtctcgaacgcctgacctcatgatctacccgcctcggcctcccaaagtgctgggattacaggcatggagcaccgtgcctggccaagattctttacaataggatttatgtaaaactttactaagctaaactgctctctgattattcaagagcaaagtattaaaaatttctcaaacttacttgacaacaaaacccattctttcagttacatctactaagagctcgtagttcaataacattccaaagaacgtagtttggaaaacactggcctatcggctgtaataggaagggtctaaagaaaattatttgctgagtcctcataatcaattggctataatcacaatttaataatttatcaatgcaaacagtacattaaaaactgtagcacaatctataatttttaccttcatatgcagagaaattaagaatttacatcttttacaaatatgtatatctctgaaataatgaaatatattgatgggtgaaataatatttctggtattttcttcattataacacgtggaatggaacagtggctagaggtatggatggagcaaggtcaaatatgagctgatggagctgggagctaaataagggtataatatgctacttctgtgtatgttgtgtatggtatagtatgctatttctgtgtatgttcaaattgtttatgtatataataaagttttaaaaatttgtatgtacttgacaattccttagaaaaaagaggctaaaataaaatagatctatgtcataatctatagaatagtcattttaaaagttacataattagtaaattcaatacaaatgtctactgagagaaaataaaaactaggatgatatacctgtaaaatagaagaacttactaatttataatacatatttgcttgtgtttacagacacatgttttcaacaaaggatataagtatattatggctaatgtttctttatatatcaattatactttgttttaaaccttaattataagaatgagatgattataggaacataaaatatctttttctaaacaatgtatcattctgctaaattatttcctaattataagatgcaaatattaatatttgagaaatgtagcaaaatgaaatataattgcaaatgagcaaagactacacttaagcttttatattcaagggcctctgttgaatatggggtattcaataaatatctgactacacaaagaaaaataaa

SEQ ID NO: 147969 - DNA, 1963 bp, Homo sapiens
  Payload ID: 9284
  Gene Symbol: LRRC2
  Gene Name: leucine rich repeat containing 2
  Uniprot ID: Q9BYS8
  ENST ID: ENST00000296144
  CDS Start-End: 183-1298
acttcaaagggcaaaagaaagaggagaacctccgcttaccacagccgggtagaaatgcctgaggaaagcagcggagctgaccgtgccagcatttacacagggaacacttcttgggcagccaggtgtcatggggcacagacccacagttcctgagaatgaacaggtaatttcatgctcccaaaatgggacataaagtggttgtcttcgacatttctgtcatcagagccttgtgggaaactcgtgtcaagaagcacaaagcttggcagaagaaggaggtggaaaggcttgagaagagcgccttggagaagataaaggaggagtggaactttgtggccgaatgcaggaggaagggcatcccccaggctgtatactgcaagaatggcttcatagacaccagcgtgcggcttctggacaagattgaaaggaacactctcacaaggcagagttcacttcccaaggacagaggcaaacggagcagtgcgtttgtgtttgaactttctggggagcactggacggagctcccagattcattgaaggagcagacacacctgagagaatggtacataagcaataccttgattcaaatcattcctacatatattcagttatttcaagcgatgagaattctggatctgccaaaaaaccaaatctcacatcttccagcagaaatcggttgtttgaagaacctgaaagaactcaatgtgggtttcaactatctgaagagcattcctccagaattgggagattgtgaaaatctagagagactggattgttctggaaatctagaattaatggagctgccctttgaattaagtaatttgaagcaagttacatttgtagatatctcagcaaacaagttttccagtgtcccaatctgtgtcctgcggatgtcgaatttgcagtggttggatatcagcagcaataacctgaccgacctgccgcaagatatagacaggctagaggagctgcagagctttctcttgtataaaaacaagttgacctaccttccctattccatgctgaacctgaagaagctcactctgttagtcgtcagtggggaccatttggtggagctcccaactgccctttgtgactcatccacacctttaaaatttgtaagccttatggacaatcctattgataatgcccaatgtgaagatggcaatgaaataatggaaagtgaacgggatcgccaacattttgataaagaagttatgaaagcctatattgaagaccttaaagaaagagaatctgttcccagctataccaccaaagtgtcttttagccttcaactttgatatccatcagaagactgcaaatctcactattctctggagctatatataaatctttgttatgatcatgtcatataggaagaatggcttgtgcttaaggacaaagtctagaaaccactatcatagttgctaaaaaaaatggttttcaaatgtcaaatacatgagtatctccctccatggactggagaattgaaaaattggtttgtatattgatatttccaggttcatttgcatatacttttttccaaataatgcacatttaatatgttttaaaatgtcttatttttaagaattataactaaaagaccaaatactgaagttaagtgcattgttttcaggaatcaaaagataaaggggccgggtgtggtggctcacacctgtaatcccagcactttgggaggccgaagtgggtggatcacctgaggtccggagttcgaggctggtttggccagcatggcgaaaccccatctctactaaaaatacaaaaaattagctgggcatggtggcagttgcctgtaatcctagctactcaggaggctgaggcaggagaatcgcttgaacctgggaggtggagttgcagtgagccgagatcatgcgactgcactccagcctgggtgacagagccagactctgtctcaaaaaaaaaaaaaaagaaaagaaaaagataa

SEQ ID NO: 147970 - DNA, 5100 bp, Homo sapiens
  Payload ID: 9284
  Gene Symbol: LRRC2
  Gene Name: leucine rich repeat containing 2
  Uniprot ID: Q9BYS8
  ENST ID: ENST00000395905
  CDS Start-End: 394-1509
cattccacaccctccgggatctccagtgtgaaaatgtctggccctgggtaggaggctgcagatagtccctgggccggggctcgcgctggccggctgcagcgcgcagggtgccaagccctcccctacgaagtctgttttgtctcaggctgggctgagtcacatagaatagatagatagttgatttagcacatgtcctccagatcatattatccgcctacaaatatagcctgttagcgcacaggcacgggaggcttcttccggctcggccgtgctgctcagcgggtgtaaacagcctctgcggtgtaaacagcctctgcggtgtaaacagccgcggcgggcaggccaggactgtcagtgcccgcccctcggggcaggtaatttcatgctcccaaaatgggacataaagtggttgtcttcgacatttctgtcatcagagccttgtgggaaactcgtgtcaagaagcacaaagcttggcagaagaaggaggtggaaaggcttgagaagagcgccttggagaagataaaggaggagtggaactttgtggccgaatgcaggaggaagggcatcccccaggctgtatactgcaagaatggcttcatagacaccagcgtgcggcttctggacaagattgaaaggaacactctcacaaggcagagttcacttcccaaggacagaggcaaacggagcagtgcgtttgtgtttgaactttctggggagcactggacggagctcccagattcattgaaggagcagacacacctgagagaatggtacataagcaataccttgattcaaatcattcctacatatattcagttatttcaagcgatgagaattctggatctgccaaaaaaccaaatctcacatcttccagcagaaatcggttgtttgaagaacctgaaagaactcaatgtgggtttcaactatctgaagagcattcctccagaattgggagattgtgaaaatctagagagactggattgttctggaaatctagaattaatggagctgccctttgaattaagtaatttgaagcaagttacatttgtagatatctcagcaaacaagttttccagtgtcccaatctgtgtcctgcggatgtcgaatttgcagtggttggatatcagcagcaataacctgaccgacctgccgcaagatatagacaggctagaggagctgcagagctttctcttgtataaaaacaagttgacctaccttccctattccatgctgaacctgaagaagctcactctgttagtcgtcagtggggaccatttggtggagctcccaactgccctttgtgactcatccacacctttaaaatttgtaagccttatggacaatcctattgataatgcccaatgtgaagatggcaatgaaataatggaaagtgaacgggatcgccaacattttgataaagaagttatgaaagcctatattgaagaccttaaagaaagagaatctgttcccagctataccaccaaagtgtcttttagccttcaactttgatatccatcagaagactgcaaatctcactattctctggagctatatataaatctttgttatgatcatgtcatataggaagaatggcttgtgcttaaggacaaagtctagaaaccactatcatagttgctaaaaaaaatggttttcaaatgtcaaatacatgagtatctccctccatggactggagaattgaaaaattggtttgtatattgatatttccaggttcatttgcatatacttttttccaaataatgcacatttaatatgttttaaaatgtcttatttttaagaattataactaaaagaccaaatactgaagttaagtgcattgttttcaggaatcaaaagataaaggggccgggtgtggtggctcacacctgtaatcccagcactttgggaggccgaagtgggtggatcacctgaggtccggagttcgaggctggtttggccagcatggcgaaaccccatctctactaaaaatacaaaaaattagctgggcatggtggcagttgcctgtaatcctagctactcaggaggctgaggcaggagaatcgcttgaacctgggaggtggagttgcagtgagccgagatcatgcgactgcactccagcctgggtgacagagccagactctgtctcaaaaaaaaaaaaaaagaaaagaaaaagataaagggattgtgaaaagagcatttatattggactaatcagatgagagtgttttgttattttgaaagagtttcttttactgagaataatcttccttgagtttatataaactgctatttccatatgttttaagttatattttggcaagtgtagactcccaggagagacttgtaggtacaatctaggccttgaagaaacaaaggctggaatatctgcccatgctttgggcatgagatgctcagatggtgcgtgggtagatctagttgaggaagtgtgggcctggctgttcatgggaagtcttcagtggccttcatggatggccatccagtcctgagtggtcaccctgggggtcctgggacacacctcagtaaagagcaaaggcaacgccctcagggtcccttcctccaagatggccatgtagggtaatggagatgaccagtccacactgataaggagttcctagcaaggcttccttgtgggtaccacaggacaactctgcccatagcaaagatgcttcagtccagagggagcccatgggctgtttgaatttgggagaggtgggattcattacaagactttgggctcttatgtcacatcacatgatttggagaaattagacacaatctcttatttttataccactgtcttgggctaaaataaacaggttgtggctgatggtgttgaagataaataagcttaaacaaataactttggccgggcacggtggctcacacctataatcccagcactatgggaggctgaggcaagcaggttgtttgagcccaggaatttgagaacaggattttgagaacagcttggacatcatgacgaaaccccatctccacaaaaaaattcaaaaaattagccaggtgtggtggcatgtgcctgtggtcccagctactcaggaggctgaggtgggaaaatcacttgagcccaggaggtcgaggctgcagtgtgctgtgattgtgacactgccctccagcctgggtgacagagtgagaccctgtctcaaaagcaaaacaaacagcaataacaatattattattgttataactaaaaaaaaaaaaacaaaaacaagcagcttttgtgactaagaaggaaaatatgcatatagtggcatatttttatatgaatcatctcctctgtggtcttgcccagtaccatccagtggagctttctgcagtgacggaaatgttctgtatttgcgttgtccaacgtggtaaaccagacacatgtgattcttgagcacttgaacaatgactgatgtgattgaagaacccatctttcaattcaattaaatttaaatagccacatttaactccagccttgggtttgacctgatggaaaattcccatgagagagtgctccaaaccgttccaaggtggggccagttgcgattctaaaggaagaagcactaaatggcagggtgatcagtccaaagcatttatgaggggagcttacatacagcatgggctgcagcgtccttgtgatgggcagtgagacaagggatgttctacctgggcatgtccccagcgagggggttgggggatggagttcacatgaagatgtaaggaatttgggtgggggctgggctggcttctacatgtttagcaacacggctgatctttcagtgtttccagcaacaacctaagcaccgttatcagtgcctaggaatgttcaaggcccaggctggggttcagacctgcagaggaaaacatcagctggctgggtcaaggcaccatgtgttacttggtcaggacagagacaaaaatgaggaaaactaggggaccccacacacatgtggctaccatactcctgaacaggtctagctagttatttgtttttttggaagttaatctggggtagaaatgtatggtgatttttattttctctgtctgaagaaccagccatttttaaaaaggttattattgacatcccaatattttgtcttggtgggcttactcataagtccaaacattttattctcaacaggtgtaaaacaggcagagcattctaaaaccacatggtagtgctttggtggaggactgcttccacttagaaacaaactctgagaagtaggctaagagaagacaagagggccgggcgcggtgactcacgcctataatcccagcactttgggaggccgagatgggtgaatcatgaggtcaggagttcgagaccagcctaaacaacatagtgaaaccctgtctctattaaaaatgcaaaaaattagccgggcgtggtgggcacccgtaatcccagctactcaggaggctgaggcaggagaattgcttgaacccaggaagcagaggttgcagtaagctgagatcccaccattgcactccagcctgggcaacagagtgagactccatctcaaaaaaaaaaaaaaaaaaaaaaaaagagagagagatgaaaagagtaggaaaatgagaaatcaccttcgttgaatcttaaatagttacatttttttctttttaacactaaaaatacaattcaaatttattagctctactacttgaatgattttggaattttatgtcatgctaaggtatgtgttacatatggccaagtggaaaatatatctgaagaggggctttcatacaaatagactgttcataatttatgtaaattttattttaataaaatcagttttttgtttaaaaaccttgtttcactgtcacatatgaaaaaaatactgcattgatatataattatttcatgttacataataacccaaaacaaataattacttgaatatgtttgtagagatactatttaatttattcatataaatgtgcagaaagattccaaaggagaatatatatcttgtgaaaatatggagatttgaaaatttgacatgatgcaaatagactgatacataatttggaaaggttatttacatggcagaatacatgtatgaatattaaagt

SEQ ID NO: 147971 - DNA, 3414 bp, Homo sapiens
  Payload ID: 9285
  Gene Symbol: LRRC20
  Gene Name: leucine rich repeat containing 20
  Uniprot ID: Q8TCA0
  ENST ID: ENST00000355790
  CDS Start-End: 479-1033
ggaggctcagtccgaggatgcctagatgttagcgagggagcacgcgctgagcttcccgaaccccatgccacaaaaacaaggcgccagcaggtcccgctcacgtcccagcgggcttctttccctggggtggggaagtgggtcaacttcgttctgatctgaaggggggtttgggactatttgggtcgctcctcacctccccacccgctccccggcttggcatggtccagagcccgggctggagccagcggtagggccagcttgcacacatggctccggaggctccggttgcccatccgagcccctgccaggctctaacgttcccaactgacaacaccagtaactaaatataggagcagatggtggggacgggctgtcgcagcggctcctttgcagaggtctccggactgcagataaggctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatc

SEQ ID NO: 147972 - DNA, 2906 bp, Homo sapiens
  Payload ID: 9285
  Gene Symbol: LRRC20
  Gene Name: leucine rich repeat containing 20
  Uniprot ID: Q8TCA0
  ENST ID: ENST00000357631
  CDS Start-End: 142-528
tcggaactcgcctggggcgccgccggcggcggagggagcgtgactgcgctgcgcagggcgctaggaggcattgtcgccgctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttc

SEQ ID NO: 147973 - DNA, 2924 bp, Homo sapiens
  Payload ID: 9285
  Gene Symbol: LRRC20
  Gene Name: leucine rich repeat containing 20
  Uniprot ID: Q8TCA0
  ENST ID: ENST00000358141
  CDS Start-End: 142-546
tcggaactcgcctggggcgccgccggcggcggagggagcgtgactgcgctgcgcagggcgctaggaggcattgtcgccgctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttc

SEQ ID NO: 147974 - DNA, 3095 bp, Homo sapiens
  Payload ID: 9285
  Gene Symbol: LRRC20
  Gene Name: leucine rich repeat containing 20
  Uniprot ID: Q8TCA0
  ENST ID: ENST00000373224
  CDS Start-End: 160-714
gcgtgactgcgctgcgcagggcgctaggaggcattgtcgccgtaagtggagccaaaagcggcccggagcgggaccacacgcttcttgccccgcaaagctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatc

SEQ ID NO: 147975 - DNA, 2959 bp, Homo sapiens
  Payload ID: 9285
  Gene Symbol: LRRC20
  Gene Name: leucine rich repeat containing 20
  ENST ID: ENST00000395010
  CDS Start-End: 228-575
ccccgcgcgccccgccccgccggctcggaactcgcctggggcgccgccggcggcggagggagcgtgactgcgctgcgcagggcgctaggaggcattgtcgccacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatctgc

SEQ ID NO: 147976 - DNA, 2903 bp, Homo sapiens
  Payload ID: 9285
  Gene Symbol: LRRC20
  Gene Name: leucine rich repeat containing 20
  Uniprot ID: Q8TCA0
  ENST ID: ENST00000395011
  CDS Start-End: 115-519
gtgcaaaggccaagctggatgtggcctgagctctcggccctgcaagaggaggctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtctccggaaggcgcaagagcccccctaccttaggccaccctcctcatgcccacccagcaaggggcagaggccacaggcctggaaccctggaagggagggaggcccatgggaggccaagcctgggggctgggggcgggtgggccgagcagcacgtggtgggtggggtgcagctggtctggatagatagcttacagcagtagtgggctctggaatgcccaagggaagaggcaaggtggggcctgcagcctggactcggcactcacagctgctgtgcaaactcaggcagatctcctgccctctctgagccttgtcacttgaaaaaaacaggaccctttccctcctttgggctccctggaggtttttaagcagtacgtgcctccaagttacctccagatcagcaggcacaggtgggcattgccaggtattttctgagcccctgcgggtttgaggccttgtttttagtgctgagagccagttgctgccctgagaagagaagacaacctccatctatttattgcttcctgagaactgacctggatgcggccctctgcagggcccagtcttcagtcctgtggtccctggactggtgggaacctgaactaggagtcctgggagagctgtggtgggaatatgggctggcactgctgcagggcaagaacattcatgtaggagcccgaggaccagcaggctgggaatggggagcaagtcacgtcagctctgtcattccccacagttaacaaattggcggggtgggaagtcctgagtgctccgtccctctagcatcactcctgagctgcgggagaggtggcccagagaacagcagagtcagttacacctgcagctcttgtctaaagtgattagatggccaccctcaccactgtccagtccagcagcagcctggctgccttgtcatggcctcctgggggcagaaggcgatgtggaccacgggatttgtagccagccagctcccaggccaacgcccaaagccctgatgacctggttcttctgaggccctcaacctggcatcttagggtatggtcaggcaacagggtgaccagctgtcctggtttcccaggacatggaactttcaatgctaaaactgggacagtacccagcaagtggggatggttggtcccctaccaggagagggcctggggctcttgcttcccgagaacgcctgtggcttgaagaaccttgactgcttggtcctcaggtatctacctcccaccttctcctcatctgtggagcaagccaactcagtgccccagaccccacctgatctgcatctttgtttgcatctccagagacacctgaggccccagagcttgaggcaaagccaggccgtccaaatcctgtgtgccgtggacgagtggccactttactactcctaaggctaagatgttgagagctcagaccactgctcagagcagtaatccctgctcagaatgctcccagttccctcgtccctgcccaggtctcttgtctcttgggaaggaactgataggtcgggccattgttgggccatcactgagcgctcagtatctcaagagactctgttcattctgctcgtatcccaaggcctggttggtcaaactctgggcaaagggttttcaggatgaggaggtcaagacaggatctccagagctaccgagttcatctgtgggtgttgggggcaagtgggggctgaagtcctgtgcaggctgcgctggccccacctgccttgtgccctggagtggggtttctccttgttgaagaagaggcatccttctctgatgtgcacaaacacaatgtatgaccagagccttgcaactcaaagtgtggtctgtggaccagcagcggcagtgacacctgggagcttgttaggaatgcagagtctaggcctcaccctatacctcccgactcagaccctgcattttagcaagacccccagctgattcctataagcactttagagtttgagaagcaaggacctaggctggggatgtcctccgagcagagggtgaagtttctctcagttctctccctgccacttccagggatctgagcctgtgctcagcctcctccctaacccaccctgggagacacttggcctgttagattgttccagagtctgcatggcactcctgaagaagggagtgtgacctgcagtcaccaggagatgagggttaggtgtgcccagccctccagacccggcctttctggttaacccctgcatgccaagctgcctgctgccccaggtcctcacctcaggcctttgaaggggcagcttctggaagttgttttctcctctgcttggagagtttgcccttgtctgtcttggaaagtgtgggcagccacagatgcccccaaatcagagctcacagtgagtgagcccctaagcttcagtctgcaataaagaatgcattggtttcatctgc

SEQ ID NO: 147977 - DNA, 663 bp, Homo sapiens
  Payload ID: 9285
  Gene Symbol: LRRC20
  Gene Name: leucine rich repeat containing 20
  ENST ID: ENST00000446961
  CDS Start-End: 140-663
ggaactcgcctggggcgccgccggcggcggagggagcgtgactgcgctgcgcagggcgctaggaggcattgtcgccgctcaggcccttttgtgagaagcagaccagcctgggggctggcggcaggacacctgtgtctgcatgctgaagaagatgggtgaggccgtggccagagtagcaaggaaggtcaacgagacggtggagagcggctctgacactctggacctggccgagtgcaagctggtctcctttcccattggcatctacaaggtcctgcggaatgtctctggccagatccacctcatcaccctggctaacaacgagcttaagtccctcaccagcaagttcatgaccacattcagtcagctccgagagctccacctggaggggaacttcctacaccgcctccccagcgaggtcagtgccctgcagcacctcaaggccattgacctgtcccggaaccagttccaggacttccctgagcagcttaccgccctgccggcgctggagaccatcaacctggaggagaacgagatcgtagatgtgcccgtggagaagctggccgccatgccagccttgcgcagcatcaacctccgcttcaacccactcaacgccgaggtgcgcgtgatcgccccgccgctcatcaagtttgacatgctcatgtc

SEQ ID NO: 147978 - DNA, 1615 bp, Homo sapiens
  Payload ID: 9286
  Gene Symbol: LRRC23
  Gene Name: leucine rich repeat containing 23
  Uniprot ID: Q53EV4
  ENST ID: ENST00000007969
  CDS Start-End: 221-1252
agccccgccccctctcttctcgcttctcagccctgcccacttctttttgtcctcagccaattagcggcccaacgccccttccgcgcctcatccgggttcccgggacgggaaagtggcgtggtaaccaggcaactactgatcaatcccctccccggctgatttgcgcatcaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaatggctgcccacccccctcacggaggacatgatgaaggaagggctttctctgctctgtaagacaggcaatgggctggctcatgcttatgtcaagctggaggttaaagagagggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggggcaacatggtggccaacctgggggagctggccaagcttcgagacctgcccaagctgcgagcgttggtgctgcttgataacccatgcacggacgaaaccagctaccgccaggaggccctggtgcagatgccataccttgaacgcctggacaaggaattctatgaggaggaggaacgggctgaggctgatgtgattcgacagaggctgaaggaagaaaaggagcaggagcctgagccccagcgtgacctggaacccgaacagtcattgatctagcagcagttctagcctctaaagatagagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatg

SEQ ID NO: 147979 - DNA, 1208 bp, Homo sapiens
  Payload ID: 9286
  Gene Symbol: LRRC23
  Gene Name: leucine rich repeat containing 23
  Uniprot ID: Q53EV4
  ENST ID: ENST00000323702
  CDS Start-End: 113-1051
gaaagtggcgtggtaaccaggcaactactgatcaatcccctccccggctgatttgcgcatcaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaatggctgcccacccccctcacggaggacatgatgaaggaagggctttctctgctctgtaagacaggcaatgggctggctcatgcttatgtcaagctggaggttaaagagagggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgat

SEQ ID NO: 147980 - DNA, 1628 bp, Homo sapiens
  Payload ID: 9286
  Gene Symbol: LRRC23
  Gene Name: leucine rich repeat containing 23
  Uniprot ID: Q53EV4
  ENST ID: ENST00000443597
  CDS Start-End: 220-1251
agtcgccgctctactctcaacggtggcgagctgcagttgccaagtgccccgtccccgttgccataacagcagtacacaacccctccttcccctcgcccgcttgctaaacagtccttccctctcgggaccaagggcctctccagaactgcttctgattgagcagaaacagggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaatggctgcccacccccctcacggaggacatgatgaaggaagggctttctctgctctgtaagacaggcaatgggctggctcatgcttatgtcaagctggaggttaaagagagggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggggcaacatggtggccaacctgggggagctggccaagcttcgagacctgcccaagctgcgagcgttggtgctgcttgataacccatgcacggacgaaaccagctaccgccaggaggccctggtgcagatgccataccttgaacgcctggacaaggaattctatgaggaggaggaacgggctgaggctgatgtgattcgacagaggctgaaggaagaaaaggagcaggagcctgagccccagcgtgacctggaacccgaacagtcattgatctagcagcagttctagcctctaaagatagagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctgac

SEQ ID NO: 147981 - DNA, 1140 bp, Homo sapiens
  Payload ID: 9286
  Gene Symbol: LRRC23
  Gene Name: leucine rich repeat containing 23
  ENST ID: ENST00000431207
  CDS Start-End: 411-599
gatttgcgcatcaggtagtcgccgctctactctcaacggtggcgagctgcagttgccaagtgccccgtccccgttgccataacagcagtacacaacccctccttcccctcgcccgcttgctaaacagtccttccctctcgggaccaagggcctctccagaactgcttctgattgagcagaaacagggtctgagcccctttgctaaggcgaattgagtgggagggttggagactgcgctttaggctggtgtaccagagggcccaaggaaattggcccagtggggagggaaaagtagaagaaatgaatggagcagggattacggatggcgcaatgggagctgagaggagaggaggaggaattggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaaggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggggcaacatggtggccaacctgggggagctggccaagcttcgagacctgcccaagctgcgagcgttggtgctgcttgataac

SEQ ID NO: 147982 - DNA, 969 bp, Homo sapiens
  Payload ID: 9286
  Gene Symbol: LRRC23
  Gene Name: leucine rich repeat containing 23
  ENST ID: ENST00000428946
  CDS Start-End: 120-308
gggacgggaaagtggcgtggtaaccaggcaactactgatcaatcccctccccggctgatttgcgcatcaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaaggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatg

SEQ ID NO: 147983 - DNA, 796 bp, Homo sapiens
  Payload ID: 9286
  Gene Symbol: LRRC23
  Gene Name: leucine rich repeat containing 23
  ENST ID: ENST00000436789
  CDS Start-End: 98-748
cgggaccaagggcctctccagaactgcttctgattgagcagaaacagggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaatggctgcccacccccctcacggaggacatgatgaaggaagggctttctctgctctgtaagacaggcaatgggctggctcatgcttatgtcaagctggaggttaaagagagggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggagatcaaagacgctggccttcagacctgatcagactcccaggggcagccaccacatgtatgacagagaacagaggat

SEQ ID NO: 147984 - DNA, 671 bp, Homo sapiens
  Payload ID: 9286
  Gene Symbol: LRRC23
  Gene Name: leucine rich repeat containing 23
  ENST ID: ENST00000429740
  CDS Start-End: 1-609
atgtcagatgaagatgatctagaagactctgagccagaccaggatgattctgagaaagaagaggacgagaaggagacagaggagggggaggactacagaaaagagggggaagagttccctgaggaatggctgcccacccccctcacggaggacatgatgaaggaagggctttctctgctctgtaagacaggcaatgggctggctcatgcttatgtcaagctggaggttaaagagagggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaaggagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctag

SEQ ID NO: 147985 - DNA, 1387 bp, Homo sapiens
  Payload ID: 9286
  Gene Symbol: LRRC23
  Gene Name: leucine rich repeat containing 23
  ENST ID: ENST00000433346
  CDS Start-End: 479-1171
tcccgggctgtgaccctccccgaggccccgcccccacggcgaaggcccggggcagttaacccttctcttgctgcggcagagtccgcacccgggcaggcccatctcagaattaacgctttgatggcatcaccgcgtcgggaatccctggggatggtgttctccaccgtcaagacctttgagccgcctgagcgactaactcctgcgcccctgaggggacattttattcagaaattaaatcattcagagttccagcactgtcgggggtcatcgggctctgtccaccgccataggcctagcattgtcaccaacggagccatagagggacctcggcccaagctggggcctcttcattgtcgaagaaggcctcttgccagaccaggatctgtgggcgcggccaggctggaggactagggcggtggcagtggccaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaatggctgcccacccccctcacggaggacatgatgaaggaagggctttctctgctctgtaagacaggcaatgggctggctcatgcttatgtcaagctggaggttaaagagagggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggtagctcactgggtcagagggtggtgcagggaagagggcactgtcctgggggtcaggatgcctgctttctagtaggctcagctactaacttcatcattatgataataactggtattattatcaagaccatagttggttccagatgctgtggagatacacagccacctagcagggctgataatatataatgtgtggataatacagagataatttaccttgatacaggtagtagcaaaatggaccataattgaggtacaaacatcagtctgtggaaatgttttaggaaaa

SEQ ID NO: 147986 - DNA, 572 bp, Homo sapiens
  Payload ID: 9286
  Gene Symbol: LRRC23
  Gene Name: leucine rich repeat containing 23
  ENST ID: ENST00000415834
  CDS Start-End: 290-572
aaacagtccttccctctcgggaccaagggcctctccagaactgcttctgattgagcagaaacagggtctgagcccctttgctaaggcgaattgagtgggagggttggagactgcgctttaggctggtgtaccagagggcccaaggaaattggcccagtggggagggaaaagtagaagaaatgaatggagcagggattacggatggcgcaatgggagctgagaggagaggaggaggaattggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaatggctgcccacccccctcacggaggacatgatgaaggaagggctttctctgctctgtaagacaggcaatgggctggctcatgcttatgtcaagctggaggttaaagagagggacctgacagacatctacttgctgcgctcctacatccatctgcgct

SEQ ID NO: 147987 - DNA, 1412 bp, Homo sapiens
  Payload ID: 9286
  Gene Symbol: LRRC23
  Gene Name: leucine rich repeat containing 23
  ENST ID: ENST00000451681
  CDS Start-End: 163-351
aattagcggcccaacgccccttccgcgcctcatccgggttcccgggacgggaaagtggcgtggtaaccaggcaactactgatcaatcccctccccggctgatttgcgcatcaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaaggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaagggaacagcatccacatggtgacaggtctggaccccgagaagttgatcagcctgcacacagtggagcttcgggggaaccagctggaaagcaccctgggaatcaatcttcctaagctgaagaacctctacctggcccaaaacatgctgaagaaggtggaaggcttggaggatctgagcaatctcaccaccttgcatcttcgagacaaccagattgacaccctgagtggcttctccagagaaatgaaatcattgcagtacctcaacctgaggggcaacatggtggccaacctgggggagctggccaagcttcgagacctgcccaagctgcgagcgttggtgctgcttgataacccatgcacggacgaaaccagctaccgccaggaggccctggtgcagatgccataccttgaacgcctggacaaggaattctatgaggaggaggaacgggctgaggctgatgtgattcgacagaggctgaaggaagaaaaggagcaggagcctgagccccagcgtgacctggaacccgaacagtcattgatctagcagcagttctagcctctaaagatagagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctgg

SEQ ID NO: 147988 - DNA, 1061 bp, Homo sapiens
  Payload ID: 9286
  Gene Symbol: LRRC23
  Gene Name: leucine rich repeat containing 23
  ENST ID: ENST00000622489
  CDS Start-End: 221-829
agccccgccccctctcttctcgcttctcagccctgcccacttctttttgtcctcagccaattagcggcccaacgccccttccgcgcctcatccgggttcccgggacgggaaagtggcgtggtaaccaggcaactactgatcaatcccctccccggctgatttgcgcatcaggaggaggactgagcttatctgactccagagctttcaggagggaagaaagatgtcagatgaagatgatctagaagactctgagccagaccaggatgattctgagaaagaagaggacgagaaggagacagaggagggggaggactacagaaaagagggggaagagttccctgaggaatggctgcccacccccctcacggaggacatgatgaaggaagggctttctctgctctgtaagacaggcaatgggctggctcatgcttatgtcaagctggaggttaaagagagggacctgacagacatctacttgctgcgctcctacatccatctgcgctatgtggatatttctgagaaccacctgacagacctgtctccactcaactacctcacccacctgctctggctcaaggctgatggcaatcggctgcgaagtgcccagatgaatgaactgccctacctgcagattgctagttttgcttataaccagattactgacactgaaggcatctctcatcctcgtcttgaaaccctgaatctcaaaggagatcaaagacgctggccttcagacctgatcagactcccaggggcagccaccacatgtatgacagagaacagaggatgcctgtttttgccccaaagctggaaattcatcacaacctgaggcccaggatctgctctgtgccggtcctctgggcagtgtggggtgcagaatggggtgcctaggcctgagcgttgcctggagcctaggccgggggccgccctcgggcaggcgtgggtgagagccaagaccgcgtgggccgcggggtgctggtaggagtggttggagagacttgcgaaggcggctggggtgttcggatttccaataaagaaacagagtgatgctcctgtgtctg

SEQ ID NO: 147989 - DNA, 1758 bp, Homo sapiens
  Payload ID: 9287
  Gene Symbol: LRRC24
  Gene Name: leucine rich repeat containing 24
  Uniprot ID: Q50LG9
  ENST ID: ENST00000529415
  CDS Start-End: 119-1660
ctgctcgggcccggccgccacctgcacggcgggggagccgctcgccgcgggagcgtcaggagggcacgcgtctgcggctgaaccgcggaagggccggtgaggaaccgggcctcgggagatggccctgagggcccccgcactgctgccgctgctgctgctactactgccgctccgcgccgccggctgcccagcagcctgccgctgctacagcgccacggtggagtgtggcgccctgcggttgcgcgtcgtcccgctgggaatcccgccagggacgcagacactgttcctgcaggacaacaacatcgcccgcctagagccgggagccctggcgccactcgccgctctgcgccggctctacctgcacaacaacagcctgcgcgccctggaggccggcgccttccgcgcgcagccgcgcctgctggagctggcgctcactagcaaccggctgcgcggcttgcgcagcggcgccttcgtaggcctggcccagctgcgcgtgctctacctggcgggcaaccagctggcgcggctgctggatttcaccttcttgcacctgccgcgactgcaggagcttcacctgcaagaaaacagcattgagctgctggaggaccaggctctagcggggctgtcctccctagcactgctggacctcagcaggaaccagctgggcaccatcagccgagaggccctgcagcccctggccagtctgcaagtcctgcgcctcacagagaacccatggcgctgtgactgcgccctgcactggctgggtgcctggatcaaggagggcggccagcggctgctcacctccagggacaggaagatcatgtgtgcagagcccccgcgcctggcgctccagagtctcctggacgtatcccacagcagcctcatctgcattccgccctctgtccacgtgcagccgctggagctcacagccaacctgggtgaggacctgcgggttgcctgccaagcctccggctacccgcagccattggtgacctggagaaaggtgccccagcctcgcgagggccggccgcgagcccaggcccagctagaaggcgggttgctgggcctgggcggacactcggcatccgacacgggcagcggcatgctcttcctcagcaacatcacgctggcgcacgccggtaagtacgagtgcgaggcctccaacgccggcggcgctgcccgcgtgcccttccggctcctggtcaacgcgtcccggcagcagccgcagcagcccgcgcaaccgccgcctccggccgcccgccccgccggcagcgagccccggcccgaggcgggcagcatggccttccgcgccctgggcgtggccacacagacggccattgcggcggccatcgcgctgctggcgctcacggcgctgctcctggtcgccatgatctgtcgccggcgccgcaggcgaaaaaaggcgcgggggcctccgggggagggagcgctgttcgtcaacgactacttggacggcccctgtacgttcgcacagctagaggagctccgcgacgagcgcggccacgagatgttcgtcatcaaccgctccaagccgctcttcgccgagggtccggcggaggcgcccgctgactgcggcccggaacagggggcggggccgggactccgcgtgcccccgccggtcgcctacgagatccactgctagggccgcgggcgcgcggatgacgtgggcgccggagattggccggtgcggcctcgcgcatgctccgtcagtaaaggtggaagccgcgcagtgtgcgctga

SEQ ID NO: 147990 - DNA, 1701 bp, Homo sapiens
  Payload ID: 9287
  Gene Symbol: LRRC24
  Gene Name: leucine rich repeat containing 24
  ENST ID: ENST00000533758
  CDS Start-End: 133-1665
tcccagcccggcgactgctcgggcccggccgccacctgcacggcgggggagccgctcgccgcgggagcgtcaggagggcacgcgtctgcggctgaaccgcggaagggccggtgaggaaccgggcctcgggagatggccctgagggcccccgcactgctgccgctgctgctgctactactgccgctccgcgccgccggctgcccagcagcctgccgctgctacagcgccacggtggagtgtggcgccctgcggttgcgcgtcgtcccgctgggaatcccgccagggacgcagacactgttcctgcaggacaacaacatcgcccgcctagagccgggagccctggcgccactcgccgctctgcgccggctctacctgcacaacaacagcctgcgcgccctggaggccggcgccttccgcgcgcagccgcgcctgctggagctggcgctcactagcaaccggctgcgcggcttgcgcagcggcgccttcgtaggcctggcccagctgcgcgtgctctacctggcgggcaaccagctggcgcggctgctggatttcaccttcttgcacctgccggagcttcacctgcaagaaaacagcattgagctgctggaggaccaggctctagcggggctgtcctccctagcactgctggacctcagcaggaaccagctgggcaccatcagccgagaggccctgcagcccctggccagtctgcaagtcctgcgcctcacagagaacccatggcgctgtgactgcgccctgcactggctgggtgcctggatcaaggagggcggccagcggctgctcacctccagggacaggaagatcatgtgtgcagagcccccgcgcctggcgctccagagtctcctggacgtatcccacagcagcctcatctgcattccgccctctgtccacgtgcagccgctggagctcacagccaacctgggtgaggacctgcgggttgcctgccaagcctccggctacccgcagccattggtgacctggagaaaggtgccccagcctcgcgagggccggccgcgagcccaggcccagctagaaggcgggttgctgggcctgggcggacactcggcatccgacacgggcagcggcatgctcttcctcagcaacatcacgctggcgcacgccggtaagtacgagtgcgaggcctccaacgccggcggcgctgcccgcgtgcccttccggctcctggtcaacgcgtcccggcagcagccgcagcagcccgcgcaaccgccgcctccggccgcccgccccgccggcagcgagccccggcccgaggcgggcagcatggccttccgcgccctgggcgtggccacacagacggccattgcggcggccatcgcgctgctggcgctcacggcgctgctcctggtcgccatgatctgtcgccggcgccgcaggcgaaaaaaggcgcgggggcctccgggggagggagcgctgttcgtcaacgactacttggacggcccctgtacgttcgcacagctagaggagctccgcgacgagcgcggccacgagatgttcgtcatcaaccgctccaagccgctcttcgccgagggtccggcggaggcgcccgctgactgcggcccggaacagggggcggggccgggactccgcgtgcccccgccggtcgcctacgagatccactgctagggccgcgggcgcgcggatgacgtgggcgccggagat

SEQ ID NO: 147991 - DNA, 2415 bp, Homo sapiens
  Payload ID: 9288
  Gene Symbol: LRRC25
  Gene Name: leucine rich repeat containing 25
  Uniprot ID: Q8N386
  ENST ID: ENST00000339007
  CDS Start-End: 655-1572
gctgggtgcagagccagaggaacgccagcgaccccagcagcgctgcggacggtgctggccgtggccgctgcggcccccgtgtccaggtgggccaggacgcagcctctgggcgccgtcgcttttccagcatcgcagaggcaaaagcgtggcagtgggacccaaaaggtaggactgaggctctagaacttgcacctgtgcagggactgcaaaccagacctgggaggaccctttcagcagcccccactccaccctatcccaggacttcccagcgacccgccgttctgggagataccgggagcgtgatcagggggcggggccgtttccaaggcaaccgcttatttgcatagggtcccgtcctggccaacgagggcgccccaaatgttcaggacatagaagaaggggttaactggcccggatctcctcctcgccttccaagcccgctaagcactggggttatctacccattccccagaaggggagactgaggcagcccaccagccaaaggaggcgaccagactggggctgcgttttaccatttcagaagcggcttgagctggtctgagctataataataaacactggcggtggaggcgagggcgaccacagggctgaggtcagggctaggattccggtgtctctacgtaggttgcttgaatggggggcaccctggcatggacgctgctgttgccgctgctgctgcgggagtcagacagcctagaaccgtcgtgcaccgtgtcctccgcggatgtggactggaacgcggagttcagtgccacgtgcctgaatttcagtggcctcagcctgagcctgcctcacaaccagtctctgcgggccagcaacgtgattctccttgacctgtctgggaacggcctgcgagagcttccagtgaccttctttgcccacctgcagaagcttgaggtcctgaacgtgctacgcaaccccttgtctcgtgtggatggggcgctggccgcccgctgtgaccttgacctgcaggccgactgcaactgtgccctggagtcctggcacgacatccgccgagacaactgctctggccagaagcctctgctctgctgggacacaaccagctcccagcacaacctctctgccttcctggaggtcagctgcgcccctggcctggcctctgcaactatcggggcagtggtggtcagcgggtgcctgcttcttggacttgccatcgctggccctgtgctggcctggagactctggcgatgccgagtggccagaagccgggagctgaacaaaccctgggctgctcaggatgggcccaagcccggtttaggcttgcagccacggtacggcagccggagcgcccccaagccccaagtggccgtgccatcctgcccctccactcccgactatgagaacatgtttgtgggccagccagcagccgagcaccagtgggatgaacaaggggctcacccttcagaggacaatgacttttacatcaactacaaggacatcgacctggcttcccagcctgtctactgtaacctgcagtcactgggccaggccccaatggatgaagaggagtacgtgatccccgggcactgagcctaagatgtcctaacctccacccagaaccccttcagtccctgctgggtgactcagggcgtcctaacgcctccatggcctcagtttccccatctgaagaatgggtacaggaaaggattgtccttgaggccccaggaagctctgccgccccctccctgtccctcatgccgctcctcagctccctcagctcctagagggggaagaggagagacccccaacaaggggacaggacggtcactgtgccaatcctgtcatcaccctcctgtggatgtacaggcagtgctcaataaatgcttcgaggctgatgaggctgctggctcagggtgcgtgggttcctcaaggtggggatttctgagttctaagaccaagtctccatctgagactcccaaattgctccccacctcccatccctgtttttttttgttgttgttgtttgtttgtttgtttttgaaactgagtgtcactctgtcacccaggctggagtgcaatgctgcggtctcagctcactgcaacctccgcctcctgggttcaagtgattctcctgcctcagcctcctgagtagctgggattacagcacccgccaccatgccgagctaatttttgtatttataatagagatggggtttcgccatgttggccaggctggtctcgaactcctgacctcaagcgatctgcccgcctcggcctcctgaagtgctgggattacaggcgtggccactgcgcccaggcacattcctcccttctgcccctctcagggccccttcccaggtccctgatctccaggcttggcctccagagcagcccacaccaaccccaaaataaaaaaatgtatatattccttta

SEQ ID NO: 147992 - DNA, 1924 bp, Homo sapiens
  Payload ID: 9288
  Gene Symbol: LRRC25
  Gene Name: leucine rich repeat containing 25
  Uniprot ID: Q8N386
  ENST ID: ENST00000595840
  CDS Start-End: 169-1086
tgcagagccagaggaacgccagcgaccccagcagcgctgcggacggtgctggccgtggccgctgcggcccccgtgtccaggtgggccaggacgcagcctctgggcgccgtcgcttttccagcatcgcagaggcaaaagcgtggcagtgggacccaaaaggttgcttgaatggggggcaccctggcatggacgctgctgttgccgctgctgctgcgggagtcagacagcctagaaccgtcgtgcaccgtgtcctccgcggatgtggactggaacgcggagttcagtgccacgtgcctgaatttcagtggcctcagcctgagcctgcctcacaaccagtctctgcgggccagcaacgtgattctccttgacctgtctgggaacggcctgcgagagcttccagtgaccttctttgcccacctgcagaagcttgaggtcctgaacgtgctacgcaaccccttgtctcgtgtggatggggcgctggccgcccgctgtgaccttgacctgcaggccgactgcaactgtgccctggagtcctggcacgacatccgccgagacaactgctctggccagaagcctctgctctgctgggacacaaccagctcccagcacaacctctctgccttcctggaggtcagctgcgcccctggcctggcctctgcaactatcggggcagtggtggtcagcgggtgcctgcttcttggacttgccatcgctggccctgtgctggcctggagactctggcgatgccgagtggccagaagccgggagctgaacaaaccctgggctgctcaggatgggcccaagcccggtttaggcttgcagccacggtacggcagccggagcgcccccaagccccaagtggccgtgccatcctgcccctccactcccgactatgagaacatgtttgtgggccagccagcagccgagcaccagtgggatgaacaaggggctcacccttcagaggacaatgacttttacatcaactacaaggacatcgacctggcttcccagcctgtctactgtaacctgcagtcactgggccaggccccaatggatgaagaggagtacgtgatccccgggcactgagcctaagatgtcctaacctccacccagaaccccttcagtccctgctgggtgactcagggcgtcctaacgcctccatggcctcagtttccccatctgaagaatgggtacaggaaaggattgtccttgaggccccaggaagctctgccgccccctccctgtccctcatgccgctcctcagctccctcagctcctagagggggaagaggagagacccccaacaaggggacaggacggtcactgtgccaatcctgtcatcaccctcctgtggatgtacaggcagtgctcaataaatgcttcgaggctgatgaggctgctggctcagggtgcgtgggttcctcaaggtggggatttctgagttctaagaccaagtctccatctgagactcccaaattgctccccacctcccatccctgtttttttttgttgttgttgtttgtttgtttgtttttgaaactgagtgtcactctgtcacccaggctggagtgcaatgctgcggtctcagctcactgcaacctccgcctcctgggttcaagtgattctcctgcctcagcctcctgagtagctgggattacagcacccgccaccatgccgagctaatttttgtatttataatagagatggggtttcgccatgttggccaggctggtctcgaactcctgacctcaagcgatctgcccgcctcggcctcctgaagtgctgggattacaggcgtggccactgcgcccaggcacattcctcccttctgcccctctcagggccccttcccaggtccctgatctccaggcttggcctccagagcagcccacaccaaccccaaaataaaaaaatgtatatattc

SEQ ID NO: 147993 - DNA, 1209 bp, Homo sapiens
  Payload ID: 9289
  Gene Symbol: LRRC26
  Gene Name: leucine rich repeat containing 26
  Uniprot ID: Q2I0M4
  ENST ID: ENST00000371542
  CDS Start-End: 109-1113
aatatttgtgcaggcgccgcaggaacgggctccgcggacgacgggctccagggacgcacaggcagcgggcctcccaccgcgggtgccgggggcgggggggctgcccccatgcggggcccttcctggtcgcggcctcggccgctgctgctgctgttgctgctgctgtcgccttggcctgtctgggcccaggtgtcggccacggcctcgccctcggggtccctgggcgccccggactgccccgaggtgtgcacgtgcgtgccgggaggcctggccagctgctcggcactctcgctgcccgccgtgcccccgggcctgagcctgcgcctgcgcgcgctgctgctggaccacaaccgcgtccgtgcgctgccgccaggtgccttcgcgggagcgggcgcgctacagcgcctggacctgcgcgagaacgggctgcactcggtgcatgtgcgagccttctggggcctgggcgcgctgcagctgctggacctgagcgccaaccagctggaagcactggcaccagggactttcgcgccgctgcgcgcgctgcgcaacctctcattggccggcaaccggctggcgcgcctggagcccgcggcgctaggcgcgctcccgctgctgcgctcactcagcctgcaggacaacgagctggcggcactcgcgccggggctgctgggccgcctgcccgctctagacgcgctgcacctgcgcggcaacccttggggctgcgggtgcgcgctgcgcccgctctgcgcctggctgcgccggcacccgctgcccgcgtcagaggccgagacggtgctctgcgtgtggccgggacgcctgacgctcagccccctgactgccttttccgacgccgcctttagccattgcgcgcagccgctcgccctgcgggacctggccgtggtttacacgctcgggccggcctccttcctcgtcagcctggcttcctgcctggcgctgggctctgggctcaccgcctgccgtgcgcgccgccgccgcctccgcaccgccgccctccgcccgccgagaccgccagacccgaaccccgatcccgacccccacggctgtgcctcgcccgcggacccggggagccccgccgctgccgcccaagcctgagcggccgcggccgcctggagcgctcgaagcttcccccatgcctttgccctccctttacactgtctgccggcgtcaacaagcgacacagaccgaaaa

SEQ ID NO: 147994 - DNA, 1809 bp, Homo sapiens
  Payload ID: 9290
  Gene Symbol: LRRC27
  Gene Name: leucine rich repeat containing 27
  Uniprot ID: Q9C0I9
  ENST ID: ENST00000344079
  CDS Start-End: 152-1303
cggcgtctccatggcgaccgcgttggctgggtggcctccattgtcgggctgctgctctcagcggcggggctcgccagcgcttcagtgggcggggacgcggcaggtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcaggacaagggtccctaggaaacaggctctgcagagactacatgagagaaaaactcgaatcatgggcgtggtagggcgtgcgcctacacatatgggagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagtattccaggccctgacacggtcatcagggaggttcattcttgtgttgctgtgactgccgccagtgccaccaccttgcgaggtgtgttggccgatggactcggtgtcctcagtgtcttctctgtcctccagctccactgaccacctggcttcacccctccctgggccccaggagtccggctggcatggaccacagccacagcacccccgtgcccctcacttggtggttggctttggccagcgggggcccccagcaggaggtcgaggaggaagggagagcgagggcctcgtctttactttcccggcttctttgtgagctgcctggagctggccgagtccagcctctccctccttctgggttccgacaatctctccttccctggtctgtcctgtgggcggctgcagcccggccctgactggcacagggctcttgcaccgcccctgtggctcacctgctccctccccaacatgaataaaccctcctgaagcc

SEQ ID NO: 147995 - DNA, 1765 bp, Homo sapiens
  Payload ID: 9290
  Gene Symbol: LRRC27
  Gene Name: leucine rich repeat containing 27
  Uniprot ID: Q9C0I9
  ENST ID: ENST00000368612
  CDS Start-End: 146-1552
aacttacccatccaaacccaaagaatggactcagagaacagtggaagaaagactttttaatgacggtcttgcaagattgggtgtctgatgggcaggcacacccagcagggttacaacaagccatttatcccctggaaatacagatatggatataaatacatataataatcaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgatagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgt

SEQ ID NO: 147996 - DNA, 2113 bp, Homo sapiens
  Payload ID: 9290
  Gene Symbol: LRRC27
  Gene Name: leucine rich repeat containing 27
  Uniprot ID: Q9C0I9
  ENST ID: ENST00000368613
  CDS Start-End: 307-1899
agctcgctgagccctcgaggcgggcggcggcaggaaggtggtgcctcggcccgtcgtgccctgtcgcctagctccagccgcgatgctgaccgcaaaggctgcccttctgaggcctggaatgtgaggcccagagcgtcggacccaactcagcctcgcccggatggggaaatcgaggcagggagcgggggtgggcgtgcgtggggatcccttgaaggcagcctcggaaaccccacggagcctgcgctgcctgggccctgtgtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgatagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgtg

SEQ ID NO: 147997 - DNA, 6374 bp, Homo sapiens
  Payload ID: 9290
  Gene Symbol: LRRC27
  Gene Name: leucine rich repeat containing 27
  Uniprot ID: Q9C0I9
  ENST ID: ENST00000368614
  CDS Start-End: 106-1698
ggctgctgctctcagcggcggggctcgccagcgcttcagtgggcggggacgcggcaggtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgagagaaaagggcactgcaggagtggagagagcgagcccagaggatgaggaagaggaaggaagagctcagcaaactcctgcctccgcggaggagcatggtggcatcaaagattccctctgccacagatctgatagataacaggaaagtaccactgaatccgcctggaaaaatgaaaccaagcaaagagaaatcgccacaagcaagtaaagaaatgagtgccctgcaggagagaaatttagaagagaagataaaacagcacgtcctccaaatgcgtgagcaaagaagattccatggccaggccccactggaggagatgaggaaggctgccgaggatctggaaattgccacagagctacaggatgaagtattgaagctaaaattgggattaaccttgaacaaagatcgtcgacgggcggccctcactggaaacctttcgcttggcctgccggcagcacagcctcaaaatacattttttaacacaaaatatggagaatcaggaaatgttcgcagataccagtgacaccaggtggctggactgatggagacgtcttcagacaggagccgctcagtcttctttcccgggcgtcgcctcctgtgtggtgccggaagagcgccaggttcagtgttaccctgagggctgatttcgcgcagcctgttgttttccttagacaggtccacgtccctctcctgaggctgtggaagatttcagccgtattaaaagaaaggacactgtgagcacgtggtctcgccttcccttcttcctgcaggttcccgccaagccatgtgacagagtgctcacactcaggcacttgcctctctcctgtcctggagcccttgttacaaaagtactcacagctttccttcacttagttatttgagtgtgggagaggagaccaggtcacccgattcccgccaagccggaagtccctgcagcaccacctttggctaggagggaggggtgacagccaaaaagggcttcgggggagtggttaccctgctccctgcccagtgacaagccctcctttcccctgggggccctcctttcccctgctccctgcccagctacggggccctcctttcagccttgaccccttcctggttgctaccactcaggctgccactcagtggactccaccccagggacacggcagggtctgcagacctccccatgctagatcagccgtatttcatgctctgtctgcccaggctgtgtagattctgtgtgacttagtctcttgtgctgagtgtttgcttggatcttgaaaacatctttggtttgatttctttaacagaggtgagactattcagactttgtttatttttgtgttaattttggtaaatatggtttcagtgagtttcctcatttcatccaagttgtgcaatgtatcagcataaagttcctcttattttcagtatctttaggatccgtaataatgtcccctcttttattcttgacctggtgttcttcatcattcttgctatggatttatcaattttgttcctcttttccaaaagccccaggttttggcttcactggatttgctgtttgtcttctgtctcatgggtctctgcgccctgcacttcgtactttccgagagtttaactggtgcttagagagaaatgcatcacttccaaacccatgtattagagaagaagggcgtgaaatttatcacctaagctttccattcaggaagctagaaaaggtgtcagtgacctgttgcggcccagcggctggagcagcagacgtttgccatttctcacgcctgagggcaggcgttggagcagctcagccggcgttgctggtcagggtctcccgtgaggctggagtcagccgtgggttgagctgctctcctctgaaggtttaactgggcttggggctcagcttccaaggtgctcacctggttgttgatcagagagcgtgtccgttgtgatcccagtcctttgaaactgtgaagcctcgccccgcggcctgccgcaggatatgttttggtaaatgtagactgtgcacttgagaagaatgtattttgagttgttgggtacattgttttgtgtgtgtcaggtgacattgactaatcctgttgctcagagctcctgtacccttactgactgacttaagcctggtttctcagttactgagagaggcctgtgaacagttctagctatgatcatgaacatgtgttttcttcttagttatgtgagtttttgctatacgtgttttggggctattttgtcagatgcctacaaatttaggattgttttatcttcctgtcgaactgaccttgtcattattatgaactatttctcttcgcctctccttttcacttcttgccttctgtggattttgtctgatactaatccaggcacactgctgctgttttggtcagcgttttcataatgcatcttcttccctccttctactgtactggatttaaagcgcaccttatagagacatcatatactcgggactccttttctttctctagctgccagttctgtgtttcagttacagtgtttggccctcacatttaaggtgcgtgtgcgtacggcggattccgtgcccatctcatgtttttattccctttattcttcttttgctgctttctgatagtgatcaatttttttatttatatctcttgtattagagttttagtaatatcttttaatattattctcttgggtgttgccttagagatttcatacatgcccttgagttcattagcatttcctgaatgagccaatgaccctgagaaggtccctcccatctgccagttccctgccattgatgctgttgctctcgtccgcctcccttccacaggtaagcacgcaagacacaggtaccgtgtgccccaacggtgtcttgactcgctgttcctagacatcagtgtttgcttcactttacccatcccgatgctcttccttcctgcagcttcatgctccaatgagggctgattttcatttagctaaataacttttttttaagtatttctttgtatcatggttatgctttgactggccgtaagttctctcagcttttgtttgtctgaaaataaatttagttcgcctttattctgcacaggacagaattctaggtggatgatttttgccattcccagaactttaaagatgggctccactgtcttctggctcccatgtgttttgttaaaaattcagtgttcaggccgggtgctgtggctcacgcctgtaatcccagcactttgggaggccgaggcgagtggatcacgaggtcaggagatcgagaccatcctggctaacacggtgaaaccccgtctctactaaaaaatacaaaaaattagccgggcgtggtggctgtagtcgcagctactcaggaggctgaggcgggagaatggcgtgaacccaggagacggagcttgcagtgagccgagatcgcgccactgcactccagcctgggcgacagagcgagactccgtctcaaaaaaaaaaaaaaaagattcaatgttcattgttatttgttgctcctttgaaggtaatgggtcttttttctttgtcttaaaattgtttctccttatctttggttttcagcagtctgtgctgtgcctggatgtaattttctttttacgtatttttcttggaatatacagaactcaaatctgggagttagcatctttcatcagttttggaaaattcttagccattttttttttttttactattttttcccctgttctccctcttctccctgagacttcagttttgtgtgtgtgtgcacatgtgtgtatgcattcgtgcgtacgagtgtgtgcatgtgtgcgcccgtgtgtatgtgcatatgtgagtgtgtgtggctgtaacctgcacgtctcttctgtcatgtgttctatttttcattcctctctgtacatcaggctagatgcctcctgtctacgtggttttagatttacgaatcctgtcttctgttgtgtcccacagaaaaacccatgaggttttttaacattaaaaacagcagctttatgatagagaaaaaaacacaaacatagacgattgtaccattgcactcagaagaaacatcccaggccctgagcagcgtgtctttcctcggccgagtcaggcttcctggtgagcctcagggagtgcatggtctcagatgccatccttctcttctccagcatttccactcacctccgtgttcttggggagtgcgtggtgtcagatcccatcctgctcctctccagagtttccggtcacctccgtgttctcagggagtgcgtggtcttggatgccatcctgctcatctccagcatttcctctcacctccgtgttctcggggagtgcgtggtgtcagatcccatcctgctcatctccagcatttcctctcacctctgtgttctcggggagtgcgtggtgtcagatcccatcctgctcctctccagcatttcctctcacctccgtgttctcggggagtgcgtggtgtcagatcccatcctgctcctctccagagtttcctctcacctccgtgttctcggggagtgcgtggtctcagatcccatcctgctcctctccagagtttcctctcacctccgtgttctcagggagtgcgtggtcttggatgccatcctgctcatctccagcatttcctctcacctccgtgttctcggggagtgcgtggtgtcagatcccatcctgctcctctccagcatttcctctcacctccgagctctcggggagtgcgtggtctcagatcccatcctgctcctctccagagtttcctctcacctccgtgttctcgttctcatctctgccggaattccacatctgctcgtgcatgccatccaccttttccactagatccttttacatcatcattataatgatttttttttaataagtgttttctttcagttttaaatttcagatgttgtgtttttcaggtctaaggtgtctggtaattttttgtggatgccgattctctgttgaaattctccatcttttcatttcctttatatctcttttcttcttttttctataatatattacatttttctaataagtttttagtgagtgtccagcattgtataagttgacccttgaacaagagtttgaattataagggtccacttataagtggatttttaaaaaaatatatattgcaaaaatttttggaaatttgcaacaatttgaaaaactttgcagatgagccacatagcctagaaatatctg

SEQ ID NO: 147998 - DNA, 1738 bp, Homo sapiens
  Payload ID: 9290
  Gene Symbol: LRRC27
  Gene Name: leucine rich repeat containing 27
  Uniprot ID: Q9C0I9
  ENST ID: ENST00000625755
  CDS Start-End: 151-1302
ggcgtctccatggcgaccgcgttggctgggtggcctccattgtcgggctgctgctctcagcggcggggctcgccagcgcttcagtgggcggggacgcggcaggtgactccagaccaaggaggatgagctgctgtccctggaagagaacggatggagggaagcagctcctacgaagttccctctgtggctgctgctgatctggaggagggtgctggtcagactaggagcttgcctgccaccccctccaaagatgttcacaagggtgttggaggcatcatcttttcctcctcaccgattttagacttgagtgaaagtggtctgtgccgtttggaggaggtctttagaatccccagccttcaacaattgcatctgcaaaggaatgccctgtgtgtgattcctcaagatttctttcagttgcttccgaacctgacttggctggacctccggtacaatagaattaaagcgcttccttctgggattggagctcaccagcatttgaaaactttgcttttagaaagaaatcctatcaaaatgttacctgtggagctggggagcgtaaccacgctgaaagcactgaacctaagacactgccctctggaattccctcctcagctcgttgtgcagaagggattggtggctatccagcgcttcctgcggatgtgggcagtagaacactctctccccagaaatccaacttctcaagaggctccaccggttagagagatgaccctccgtgacctcccgagcccaggactggagttgtctggagaccacgcgtctaaccaaggagctgtgaacgctcaggacccagagggggctgtgatgaaagagaaggccagctttctcccacctgtggaaaagccagacctgagtgaactcaggaagtctgcggactcctcagagaactggcccagcgaggaggagatcaggcgcttttggaagctgaggcaggagattgttgagcacgtgaaggcagacgttctgggagatcagctcttgacgagggaattacctccaaatctcaaggcggccttgaacattgagaaagaactaccaaagccaagacacgttttcagaaggaagacagcctcctccaggagcatcttacccgacctcttgtcaccgtaccaaatggcgatccgagcaaaaagactggaagagagccgagcggcggcgctccgagagctccaggagaagcaggctctgatggagcagcagagacgtcctttcctcctcattttccctagagtattccaggccctgacacggtcatcagggaggttcattcttgtgttgctgtgactgccgccagtgccaccaccttgcgaggtgtgttggccgatggactcggtgtcctcagtgtcttctctgtcctccagctccactgaccacctggcttcacccctccctgggccccaggagtccggctggcatggaccacagccacagcacccccgtgcccctcacttggtggttggctttggccagcgggggcccccagcaggaggtcgaggaggaagggagagcgagggcctcgtctttactttcccggcttctttgtgagctgcctggagctggccgagtccagcctctccctccttctgggttccgacaatctctccttccctggtctgtcctgtgggcggctgcagcccggccctgactggcacagggctcttgcaccgcccctgtggctcacctgctccctccccaacatgaataaaccctcctgaagcca

SEQ ID NO: 147999 - DNA, 5971 bp, Homo sapiens
  Payload ID: 9291
  Gene Symbol: LRRC28
  Gene Name: leucine rich repeat containing 28
  Uniprot ID: Q86X40
  ENST ID: ENST00000301981
  CDS Start-End: 241-1344
cccgctccctcttccccagctccctctggcgcgggttccgctccacccccggagccccgcccccgacgcccggcgctccgccccgccctcgcctggctccctgccccgccccgcccgccgtcccccgcttggcttccagcgccgcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaggacccatttgtcttctgtgtttttcctttttatgtgagtgtgtcttttacagaaaccatttagattgatgggcctccccaaatctaatttaaagcaagtttccggtccttggagaacagtgacttgatcatctagccagattcccttttgaacacacataccttcagtgatgcttcctctcctctcccctcccttgctttccccagagagttatttccctgagaccatgttctccacagtgtctccagtggaaacttgtcagtttttgaggagtttcagcaaaccccgtggcctcaatggtcttgagtagcagggtggggcgcctgagttggcagcaaagtgaggctcccatggaggctcagtgagggtcccagagcacacaccctctggaaagttccagccttgtttatacgttctacagtgtagcaacagacttttgtgagggattttaaaaacaaaaatgtagattgtaatgaaatacacttcctgttttttaaaagtgtttgcagaaaaatgatttttgaagtttttaaatttcctgataagattttttttatatgagaagaatttgaggaatatttgaagctttacaagatctgatttttttctttctcaatataaagtttccatacaatgagaaagggggagaaaacacacattgaaataagacctccgtgttcttttttgatgggtttatgattcagtttatactgactttgaaatatttttgtcacatgtgaaaggcttcagctacttccactactggtttttttttgttgttgttgagacggagtctcgctctgtcgcccaggctggagtgcagtggcgggatctcggctcactgcaagctccgcctcccgggttcacgccattctcctgcctcagcctcccaagtagctgggaccacaggcgcccgccaccacgcccggctaattttttgtatttttagtagagacggggtttcaccgtgttagccgggatggtctcgatctcctgacctcgtgatccgcacgcctcggcctcccaaagtgctgggattacaggcgtgagccaccgcgcccggcccactactggtttttaacaggatgattcaaagtacagcccgtgcacatttacttcgtcacctggtgcaccacactgtcttcatgttggccctcgtttcttgtatacttagcttactgcccagatgcaactgagaaaatacaggaaaagcaggtccaaattcagccttcgacttctgcaaaagtccataaacagaaagtctgtgagcctccaccctgccagaaagaactcttcatgaagaagtcacgtatttgctcttcctttcaaaggatggcattttaatgttgctttgctgccagatgttcatctgcttgctgtgaagtgattctttttttaaaatgttttttaatgatgtaagttttctaaaaggcagggctgaatggagaaccaagaatttgcttggtagaaaaattatttttttttaatttcagacttatcaaaaatttggttgagggaatttttattagctgccctgactttataatgctacgctcttaacagtgccaaaaatcctacatagttactgacaaatgtgtgatctttttacagtcacaacacctgctgcccggaaagcacaccgtccacgtagaatggagaaggcagaaagttaccgtgtgttcccactgtatctgcactgttcttacttcctcttgtcccttttcatatcttggtctattcagccttaacatttcaaaggcttatagtaaaataggaactgaagatctgtatcaaaatgtaacactttcatcctttggaataattgaagtttaacataacctctacatgtatataagttagctggtgaaaatgtggcatgaaacttcacaattgtgcttcaggcctaagtgactgctacctatgatttaagtgacagtaaatgtcttgctacatttttctatttcatcctctacaatcatatgtcatggaatggagctatgaaatgtgctaacttggtattcaggattctcattgtgataaggtgatacattagttttaccttgtttgaaattttacaaaaatgcttacaatccaggcattctttctctacctattatgaactacggtgtgttaaacaacagcagtgggctgggcagacaacctttgggcagtctcaaccttaatccttgggtacagcacctgaacttaattgatgagaagtggaacttaagtggtttccctggtgctgttcattatggaaattttatgctggatttatcgatgtcattcttaatcttttgatactataaaggagtcttaccaactggagaaaatttgcctacatgctatatatttgaattgtgtccaaagctttgcagaaaagcaaatctgaagttattatatatgttgttttcttgagcaacagttacactaggtagaaaagtattcacacaataatagtaatgcaaaaaaagtgagctacttggaaagtatcatctctgttcaggtaagtttacttcagtgaactcttgtgtggttagcgataagttttaaagtccaggatagcctcatgagcataggccttcctatgaagtagtgcaaagggggccgattttagtggattaccctatcagtgttcttcagtatgtccaattgttatcataccaaaaaccttaattacataacattgtgtggatgaaatgctgcatcttcagttaatacatgttttgagcacattcttaaaatacataataattaaatgatccctattcaaaagaaccctggcttgggtggaggatccactctggctaacggataagagtgatgaacttctttgttacctgacccttctcttctggaaaagtgaggtgtacattaaacatcttttggtcaccgtgcctcactaagacctttcacattccagcttgtccgactagtgtaatgtacctctcacttctgttttacgttgagcattacgaattaaaatctttacagtctagggggaaaaaaaggcttcaataccagttggcttatgaggctctgcatataattttctctaaaatatgtaactattttgtagtctgtggggactttcaaagccaatttttaaaattagtagtagtaaaggtttttccctttcctgaatgaaaaatcagaaattctaatctttgctataaagtacttaaacacaatacattgcctcagcataaataaaaacatttttattaagatgatttatgaacatggatttctaactggaccaacactaatgttgcaacctgataaaatttgagatgtaaattcatttcacagactcataaacacactctctttaagactcttctttaaatggatccttacattaccctgcctgttttattatgccttcatttttgtggttttcattcactcctgcttgcttctattgaggttctcctacatttcccagaaactcagtgaatatcttgccttttcttcaaacaaagggggtttttataaagtttgtatttttgaaactagctctatgtctatctaaaaatcaagtctcggcagtggctcatgcctataatcccagcactttgggaggccgaggagggcagatcatctgaggtcaggagtttgagaccagcctggccagcatggtgaaaccccatctctactaaaaatacaaaaaattagccaggcgtggtggcgcgcacctgcagtcccagctactcgggaggctgaggcaggagaattgcttgaacccggcaggaagaggttgcattgagctgagatcacgccattacactccagcctgggcaacagagcgagactccgtctcaaaaaaaaatcattcaagtttcactgtgcctacagtgaggagctacctccttgtgtcatcagctaatagatctgaaagtgatgccggtgtctctaggaaaggaattgatcatagccaagtgactgacattctctcggtcaggaaaagagcttgcttcacagcctttgaagtatgactgtatgtgtggtccccttgtactttggagacagaaggtactggcagcgagtgtggtggatgggcagaaggtgtagcattcggagattatttctgtatgtaattaagagactttcaagggttagccagacttttttccactcaagtgtggattatctttgctacctgtgttaaagaatatcaggttttgtttcttattgtgatttttgagtctaaatgatccaagatttttaaaatagatacataatgaaatccaggcctctgaaaaattatggcaacattcatttggagtgtggctaaaaactcatactttatccaatttggttgcctctctcagttactgcagtttatagaataattgagcttgaaccatgtgaatgctcagaatgtcaatggtggagtatttattcaagagaaatggctgaatctcgatacgaa

SEQ ID NO: 148000 - DNA, 752 bp, Homo sapiens
  Payload ID: 9291
  Gene Symbol: LRRC28
  Gene Name: leucine rich repeat containing 28
  ENST ID: ENST00000331450
  CDS Start-End: 277-558
ggtgagtagagctgtccgcctcgtcgggtgattcaagtggcgaggctctctgacccggccccccggcggggacgccccagacgtggtcctgccaaagcgtccgggtcgcggcgagtgggacagcggagccgtccgggcctcgggtggccacagctgccgggtcctcctcccactctgcggcccgcggcccctgggacccgagaaccctgataccggaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactgaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaagga

SEQ ID NO: 148001 - DNA, 1235 bp, Homo sapiens
  Payload ID: 9291
  Gene Symbol: LRRC28
  Gene Name: leucine rich repeat containing 28
  Uniprot ID: Q86X40
  ENST ID: ENST00000447360
  CDS Start-End: 98-1036
gcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaaggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaagga

SEQ ID NO: 148002 - DNA, 574 bp, Homo sapiens
  Payload ID: 9291
  Gene Symbol: LRRC28
  Gene Name: leucine rich repeat containing 28
  ENST ID: ENST00000561253
  CDS Start-End: 117-341
ccgcttggcttccagcgccgcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactgtggaacttgaattgagatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgcta

SEQ ID NO: 148003 - DNA, 744 bp, Homo sapiens
  Payload ID: 9291
  Gene Symbol: LRRC28
  Gene Name: leucine rich repeat containing 28
  ENST ID: ENST00000558861
  CDS Start-End: 235-744
tggctggctaactcgggcgaaacggcgtgtgttttgcctaagactctgccagtgtttgttaccacagctgagaaaatagccttttacaaatgcttttaatatgtagcttatagttctctaatctccagcgttaggaaattggaatgcgtattctactaaattgagtacggggagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatgg

SEQ ID NO: 148004 - DNA, 967 bp, Homo sapiens
  Payload ID: 9291
  Gene Symbol: LRRC28
  Gene Name: leucine rich repeat containing 28
  ENST ID: ENST00000561276
  CDS Start-End: 66-967
cgctggctctgctggcgctgagaaatggaccaattttgacaagatatagtgctgcagcgtgcctgatgggatatattcagtcatggcgtccgaactttccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagac

SEQ ID NO: 148005 - DNA, 793 bp, Homo sapiens
  Payload ID: 9291
  Gene Symbol: LRRC28
  Gene Name: leucine rich repeat containing 28
  ENST ID: ENST00000558471
  CDS Start-End: 140-322
tgccccgccccgcccgccgtcccccgcttggcttccagcgccgcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaag

SEQ ID NO: 148006 - DNA, 581 bp, Homo sapiens
  Payload ID: 9291
  Gene Symbol: LRRC28
  Gene Name: leucine rich repeat containing 28
  ENST ID: ENST00000558879
  CDS Start-End: 241-423
cccgctccctcttccccagctccctctggcgcgggttccgctccacccccggagccccgcccccgacgcccggcgctccgccccgccctcgcctggctccctgccccgccccgcccgccgtcccccgcttggcttccagcgccgcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcact

SEQ ID NO: 148007 - DNA, 1045 bp, Homo sapiens
  Payload ID: 9291
  Gene Symbol: LRRC28
  Gene Name: leucine rich repeat containing 28
  ENST ID: ENST00000559433
  CDS Start-End: 143-328
ccctgccccgccccgcccgccgtcccccgcttggcttccagcgccgcttgcgctccggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactg

SEQ ID NO: 148008 - DNA, 644 bp, Homo sapiens
  Payload ID: 9291
  Gene Symbol: LRRC28
  Gene Name: leucine rich repeat containing 28
  ENST ID: ENST00000558172
  CDS Start-End: 88-644
cggagcgctggctctgctggcgctgagaaatggaccaattttgacaagatatagtgctgcagcgtgcctgatgggatatattcagtcatggcgtccgaactttgtaagacgatctctgtggcaaggctagaaaagcacaagaatttgttcttaaattataggaatctgcaccattttccattggagttactgaaagatgagggactgcagtacttggagagactctatatgaaaaggaactccctgacatccttgtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaa

SEQ ID NO: 148009 - DNA, 703 bp, Homo sapiens
  Payload ID: 9291
  Gene Symbol: LRRC28
  Gene Name: leucine rich repeat containing 28
  ENST ID: ENST00000560236
  CDS Start-End: 1-114
tttcccttgagagagacgccaatggcagggctgcaccagtggaagacaactgttagttttgtggcttactgctgctccacccagtgtctgcagacttttgacctgctgagttgataaacactcaagaacctcaggagcgctgccagcttgacactggggaatccagccagtccagcacactcttccatcctgtcctgtccaatgcgggggcactgcagaactctctagaaatgtcatgattgagcttcagagctaaaatgccttcacccttcccccaagttggaatatatcctcccccaaattaaggacccatttgtcttctgtgtttttcctttttattcacaacacctgctgcccggaaagcacaccgtccacgtagaatggagaaggcagaaagttaccgtgtgttcccactgtatctgcactgttcttacttcctcttgtcccttttcatatcttggtctattcagccttaacatttcaaaggcttatagtaaaataggaactgaagatctgtatcaaaatgtaacactttcatcctttggaataattgaagtttaacataacctctacatgtatataagttagctggtgaaaatgtggcatgaaacttcacaattgtgcttcaggcctaagtgactgctacctatgatttaagtgacagtaaatgtcttgctacatttttctatttcatcctctacaa

SEQ ID NO: 148010 - DNA, 1468 bp, Homo sapiens
  Payload ID: 9292
  Gene Symbol: LRRC29
  Gene Name: leucine rich repeat containing 29
  Uniprot ID: Q8WV35
  ENST ID: ENST00000393992
  CDS Start-End: 426-1097
gttcctcctttgggccactctgtccctttagcttgggggaccgtcctccccttccctatcggccccagaagatagctgccctgtcatctccgcgagaacaggccctctgcccatccccttcccttgaagtggctgtctcctccccgctcagttctggaagatgtccgctccatctcatcgtcccgaaggatgctcacatatattctgagcttcctgcctctgtcagatcagaaagaggcctccctcgtgagttgggcttggtaccgtgctgcccagaatgcccttcgggagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagcctcgacatggccgagggcgggaactggcccaggccctgggctgtatgcacggggctccatcccagctggcctccctcagcctggcccactgctcttcattgaagtcacgcccagagctggagcatcaggcctcaggtaccaaggacgcctgtccagagccacagggcccctccctgctcacgctgcgggccctgcaggagttggacctcacagcctgcagcaagctgactgatgccagtttagccaaggtgctccagtttctccagctgaggcagctgtcccttagcctgttgccagaactcacagacaacggcttggttgctgtggccaggggctgtcctagcctggagcacttggcgctgagtcactgcagccgactcagtgacaagggctgggcccaggcagccagctcctggccaaggctgcagcatctcaacctgtccagctgcagtcagctcatagagcagacactggatgctattgggcaggcgtgcaggcagctccgggtgttggatgtggccacgtgccctggcatcaacatggccgccgtcagacgcttccaagcccagctgccccaggtgtcctgtgtccagtcccgcttcgtgggaggggctgacctgaccctaacactctgaggccagaccctctaggactgggggtggggccaatccagggcagcccagagggaacatcctgccacaccgcctggcagtagcctctttccagctacacgtcgctgccacaggcccctggaaatgctacctacgtgttgccgccacaggctcctgctctctggccaagccctgggtgggaggccaggcccccagcgggcagggtctggtgctgggaggagcagagcctctgcctcttgcctgccctcctctcagacctaaggccgggctccacctactcctgtgggactctcccagcaccctgtgtgcactgagcttcagcagctgagcctaggtctgtgctgtaaatcctaagattaaacattccagatagt

SEQ ID NO: 148011 - DNA, 1410 bp, Homo sapiens
  Payload ID: 9292
  Gene Symbol: LRRC29
  Gene Name: leucine rich repeat containing 29
  Uniprot ID: Q8WV35
  ENST ID: ENST00000409509
  CDS Start-End: 273-944
ggcagggatgcgatggcggagtcgctgcccctggagatgctcacatatattctgagcttcctgcctctgtcagatcagaaagaggcctccctcgtgagttgggcttggtaccgtgctgcccagaatgcccttcgggagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagcctcgacatggccgagggcgggaactggcccaggccctgggctgtatgcacggggctccatcccagctggcctccctcagcctggcccactgctcttcattgaagtcacgcccagagctggagcatcaggcctcaggtaccaaggacgcctgtccagagccacagggcccctccctgctcacgctgcgggccctgcaggagttggacctcacagcctgcagcaagctgactgatgccagtttagccaaggtgctccagtttctccagctgaggcagctgtcccttagcctgttgccagaactcacagacaacggcttggttgctgtggccaggggctgtcctagcctggagcacttggcgctgagtcactgcagccgactcagtgacaagggctgggcccaggcagccagctcctggccaaggctgcagcatctcaacctgtccagctgcagtcagctcatagagcagacactggatgctattgggcaggcgtgcaggcagctccgggtgttggatgtggccacgtgccctggcatcaacatggccgccgtcagacgcttccaagcccagctgccccaggtgtcctgtgtccagtcccgcttcgtgggaggggctgacctgaccctaacactctgaggccaggtcagtaaccagccctgcagcacagcctccttgactcccccagtctccaaccctggccttgacccgggttgctttttgcctccctctactgcagaccctctaggactgggggtggggccaatccagggcagcccagagggaacatcctgccacaccgcctggcagtagcctctttccagctacacgtcgctgccacaggcccctggaaatgctacctacgtgttgccgccacaggctcctgctctctggccaagccctgggtgggaggccaggcccccagcgggcagggtctggtgctgggaggagcagagcctctgcctcttgcctgccctcctctcagacctaaggccgggctccacctactcctgtgggactctcccagcaccctgtgtgcactgagcttcagcagctgagcctaggtctgtgctgtaaatcctaagattaaacattccagatagta

SEQ ID NO: 148012 - DNA, 1940 bp, Homo sapiens
  Payload ID: 9292
  Gene Symbol: LRRC29
  Gene Name: leucine rich repeat containing 29
  Uniprot ID: Q8WV35
  ENST ID: ENST00000409037
  CDS Start-End: 898-1569
cccaatgcccagcaccctctgaagccagagggctacccccaggcctgctgctgctccgtagacagatgtgcgatacaacatccccgtgtcctctgcctccctctcggccatcaagagcctgggcctcaggggcatctgctgcatcagcctgaccaacctggatggctctctggcttcacaccaggtgctacaatctgttgcttaccacctgggcccacacctgcagagcttgtccctgggtggaggcagccccacagaggcctcctctgtggccctgatcctgggctgcccagccctgtgtgtccttgacctcagtggctgcaatagcctcttcacctcgggcacactgctggctcagccagagatggcacagagcgtccagcaggctttgagcggcctccgtgagctcaacctggctggcctgcgagacctggctgacctcagcttcaaccagctcagcagctgtgcccccagcctggagcgcctctccttggcatactgccacctcaccttcgagctaggcccagcctgaggctccatcggcccccaagactcctctcccgcccagttctccttctgcaacctgctgcgattagtgcaagagcgggctggcaggctgcgtgccctggacctgagtggcactggcttgccccccgaggccctgcaggctctgggccaggtagctgggctgcagcttcaggagctgagcctgcacagctgccgggacctctccacagaggctgtggctaccctgtgcttccagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagcctcgacatggccgagggcgggaactggcccaggccctgggctgtatgcacggggctccatcccagctggcctccctcagcctggcccactgctcttcattgaagtcacgcccagagctggagcatcaggcctcaggtaccaaggacgcctgtccagagccacagggcccctccctgctcacgctgcgggccctgcaggagttggacctcacagcctgcagcaagctgactgatgccagtttagccaaggtgctccagtttctccagctgaggcagctgtcccttagcctgttgccagaactcacagacaacggcttggttgctgtggccaggggctgtcctagcctggagcacttggcgctgagtcactgcagccgactcagtgacaagggctgggcccaggcagccagctcctggccaaggctgcagcatctcaacctgtccagctgcagtcagctcatagagcagacactggatgctattgggcaggcgtgcaggcagctccgggtgttggatgtggccacgtgccctggcatcaacatggccgccgtcagacgcttccaagcccagctgccccaggtgtcctgtgtccagtcccgcttcgtgggaggggctgacctgaccctaacactctgaggccagaccctctaggactgggggtggggccaatccagggcagcccagagggaacatcctgccacaccgcctggcagtagcctctttccagctacacgtcgctgccacaggcccctggaaatgctacctacgtgttgccgccacaggctcctgctctctggccaagccctgggtgggaggccaggcccccagcgggcagggtctggtgctgggaggagcagagcctctgcctcttgcctgccctcctctcagacctaaggccgggctccacctactcctgtgggactctcccagcaccctgtgtgcactgagcttcagcagctgagcctaggtctgtgctgtaaatcctaagattaaacattccagatagt

SEQ ID NO: 148013 - DNA, 785 bp, Homo sapiens
  Payload ID: 9292
  Gene Symbol: LRRC29
  Gene Name: leucine rich repeat containing 29
  ENST ID: ENST00000424285
  CDS Start-End: 290-785
ccagcctggcggaaacgacccgccctcccgatcccgggaccttctagctctggatgctcacatatattctgagcttcctgcctctgtcagatcagaaagaggcctccctcgtgagttgggcttggtaccgtgctgcccagaatgcccttcgggagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagcctcgacatggccgagggcgggaactggcccaggccctgggctgtatgcacggggctccatcccagctggcctccctcagcctggcccactgctcttcattgaagtcacgcccagagctggagcatcaggcctcaggtaccaaggacgcctgtccagagccacagggcccctccctgctcacgctgcgggccctgcaggagttggacctcacagcctgcagcaagctgactgatgccagtttagccaaggtgctccagtttctccagctgaggcagctgtcccttagcctgttgccagaactcacagacaacggcttggttgctgtggccaggggctgtcctagcctggagcacttggcgctgagtcactgcagccgactcagtgacaagggctgggcccaggcagccagctcctggccaaggctgcagcatctcaacctgtccagctgcagtcagctca

SEQ ID NO: 148014 - DNA, 786 bp, Homo sapiens
  Payload ID: 9292
  Gene Symbol: LRRC29
  Gene Name: leucine rich repeat containing 29
  ENST ID: ENST00000433915
  CDS Start-End: 302-786
ggcggcagggatgcgatggcggagtcgctgcccctggagatgctcacatatattctgagcttcctgcctctgtcagatcagaaagaggcctccctcgtgagttgggcttggtaccgtgctgcccagaatgcccttcgggagaggctgtggctaccctgtgcttccagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagcctcgacatggccgagggcgggaactggcccaggccctgggctgtatgcacggggctccatcccagctggcctccctcagcctggcccactgctcttcattgaaggtgctccagtttctccagctgaggcagctgtcccttagcctgttgccagaactcacagacaacggcttggttgctgtggccaggggctgtcctagcctggagcacttggcgctgagtcactgcagccgactcagtgacaagggctgggcccaggcagccagctcctggccaaggctgcagcatctcaacctgtccagctgcagtcagctcatagagcagacactggatgctattgggcaggcgtgcaggcagctccgggtgttggatgtggccacgtgccctggcatcaacatggccgccgtcagacgcttccaagcccagctgccccaggtgtcctgtgtcca

SEQ ID NO: 148015 - DNA, 941 bp, Homo sapiens
  Payload ID: 9292
  Gene Symbol: LRRC29
  Gene Name: leucine rich repeat containing 29
  ENST ID: ENST00000447579
  CDS Start-End: 396-941
gcttgggggaccgtcctccccttccctatcggccccagaagatagctgccctgtcatctccgcgagaacaggccctctgcccatccccttcccttgaagtggctgtctcctccccgctcagttctggaagatgtccgctccatctcatcgtcccgaaggatgctcacatatattctgagcttcctgcctctgtcagatcagaaagaggcctccctcgtgagttgggcttggtaccgtgctgcccagaatgcccttcgggagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagcctcgacatggccgagggcgggaactggcccaggccctgggctgtatgcacggggctccatcccagctggcctccctcagcctggcccactgctcttcattgaaggatgcctcagtgctctccatgatcccagcactgggcctgagcctcagggtgctagacctgtcctcctgtgtggccctcaccaacaggaccctgcaggccatctgcacctacctcacccacctctcagtcctgcgcctggcgtggtgcagggagctctgtgactgggggcttcgggggctgggggagcctgtgcaggggacccaggtgtgggaccctcgaggtcttggaggacggggtggcccctgggatcagctgccctcctgcccctcccaagtctctgtaggagtatttaagggcaaactcaggaggaacctgagaagcaaaggcttcttcccacagtcacgcccagagctggagcatcaggcctcaggtaccaaggacgcctgtccagagccacagggcccc

SEQ ID NO: 148016 - DNA, 1303 bp, Homo sapiens
  Payload ID: 9292
  Gene Symbol: LRRC29
  Gene Name: leucine rich repeat containing 29
  Uniprot ID: Q8WV35
  ENST ID: ENST00000629962
  CDS Start-End: 261-932
atggcggagtcgctgcccctggagatgctcacatatattctgagcttcctgcctctgtcagatcagaaagaggcctccctcgtgagttgggcttggtaccgtgctgcccagaatgcccttcgggagcaaccaggccttacctccctggacctcagtggctgctcagaactgactgatggggcgctcttggccgtgagccggggcctgcggcacctgcggcgcctgagcctggggaagctgcagcggctgacagatgcaggatgtacagctctgggtggcctgcaggagctgcagagcctcgacatggccgagggcgggaactggcccaggccctgggctgtatgcacggggctccatcccagctggcctccctcagcctggcccactgctcttcattgaagtcacgcccagagctggagcatcaggcctcaggtaccaaggacgcctgtccagagccacagggcccctccctgctcacgctgcgggccctgcaggagttggacctcacagcctgcagcaagctgactgatgccagtttagccaaggtgctccagtttctccagctgaggcagctgtcccttagcctgttgccagaactcacagacaacggcttggttgctgtggccaggggctgtcctagcctggagcacttggcgctgagtcactgcagccgactcagtgacaagggctgggcccaggcagccagctcctggccaaggctgcagcatctcaacctgtccagctgcagtcagctcatagagcagacactggatgctattgggcaggcgtgcaggcagctccgggtgttggatgtggccacgtgccctggcatcaacatggccgccgtcagacgcttccaagcccagctgccccaggtgtcctgtgtccagtcccgcttcgtgggaggggctgacctgaccctaacactctgaggccagaccctctaggactgggggtggggccaatccagggcagcccagagggaacatcctgccacaccgcctggcagtagcctctttccagctacacgtcgctgccacaggcccctggaaatgctacctacgtgttgccgccacaggctcctgctctctggccaagccctgggtgggaggccaggcccccagcgggcagggtctggtgctgggaggagcagagcctctgcctcttgcctgccctcctctcagacctaaggccgggctccacctactcctgtgggactctcccagcaccctgtgtgcactgagcttcagcagctgagcctaggtctgtgctgtaaatcctaagattaaacattccagatagt

SEQ ID NO: 148017 - DNA, 5869 bp, Homo sapiens
  Payload ID: 9293
  Gene Symbol: LRRC3
  Gene Name: leucine rich repeat containing 3
  Uniprot ID: Q9BY71
  ENST ID: ENST00000291592
  CDS Start-End: 318-1091
ccccgcccctcgcccgcgcaggccggagtcgcggcctccccagctagtggtcgcgggcgcggtcgcaggggcagcggggtggccgccgcgccaggcgtggagctgggtctggcgggctccgagaggcccgggagcggcgcgcagagcagcctccggccgccgccgcgcagagctgccagagtggactgcactgcttctcccagcggggcaggatggcggtttcatgtctggttggataaggccttgcctgcggaaaccagctccatccccaggccctagcagaggctcgcgtgtccccgtccccaggtcaggtcaggatgggcaccgtgcgcccacctcgcccctcgctcctgctggtctccacccgggagtcttgtctcttcctcctcttctgcctgcacctgggcgccgcctgcccacagccctgccggtgccctgaccacgcaggggctgtggctgtcttctgcagcttgcggggccttcaggaggtccccgaggacatcccggccaacaccgtgctcctgaagctcgatgccaacaagatctcccacctcccggacggggccttccagcacctgcaccggctcagggagctggatctgtctcacaacgccatcgaggccatcggctccgccaccttcgcgggcctggccgggggcctgcggctgctggacctgtcttacaaccgcatccagaggatccccaaggacgccctgggcaaactcagcgccaagatacgcctgtcccacaaccccctgcactgcgagtgcgccctgcaggaggccctgtgggagctgaagctggaccccgactctgtggacgagatcgcctgccacacctcagtgcaggaggagtttgtggggaagcctctggttcaggctctggatgcgggtgccagcctctgcagcgtcccccacaggaccacagacgtggccatgctggtcaccatgttcggctggttcgccatggtgatcgcctacgtcgtgtactatgtgcgccacaaccaggaggatgcccggaggcacctggagtacctgaagtctctgcccagcgcccccgcctccaaggaccccatcggcccggggccctagcgcctgttccggcagacccccgccggtggctgctgtcacttttgtagtaggtggtgactgatgctgcttttgctcttccctgaggcaggtgtcacagccatgtgtgctccccactgttgcactcaggcacagcagcacctccaggctgggtggttttgccacacatccgtgtgacggatgaggaacctgaagcttagaggaacggaatgactgcccgtgacgataccatcaggaaattatcccagtggaacttcaacccgggctgtccatcgtgacattccgcctccttccaccatgccagcctctcccacacggggccctgcaggctgtggatatgcactcagaggactaagggggtgctctgcaagcgagagggttcaccagagggagcttgggtgcaggttcacccgctgaaggcgctgataagtcctgtgctgaggagctgacttgcccttgtttacttacaaagtgcattgtaggtaaacatgagccttgttccagtgttcgaagtacattggaacgtaagccctgtttccagagcaaagtaacagagaccaggtttttctagagagctaagtgggatgtgtagctcaaacaaactgtcctacccttttttattctcaaatgtttgttttgagtaaccgtagtgccaaaatttcagttcagtaatggggtgaacaatatggagagagacctgggaaaagtccagggtagcttgcccaggggaagacagcagccacatacctgggggcccgcctgcttcctgcccctctgggtgtgcctgatgcgggaggccctgccccagggcgatctcagctcactgcaacctttgcctcccaggctcaatcacttctgctgcctcagcctccctagtagctggaattacaggcatgagccaccacgcctggctaatttttgtatttttagtagagaccgggtttcaccatgttggccaggctggtctcgaactgttggcctcaagtgatccgcccgcctcagcctcccaaagtgctgggattacaggcgtcagccaccgcgcccggccctgtgccttgctttttctactcactaagatataaaacagctctttttccaaggcccggagtactggggattgatgtttcaaggccaatcaatgggatgcttcgttttctccagcaacaggaactctctcttttcacctttgctgccaggaatctcagagataatttagtgctcaatttactaaccttacttcacattcaggttagatgttacctccacctatatgatagtaattcctaattttattttttattgtcctttttatgagtgtttatattttaaagtactttgagtatttttggggggggtgtaaatgagtgatcagtgtacattgtgtgtggactgaagtgtaggtatgtagagatgcttcgccaaacagatgcttaaaaatgaatggaagttgagggtggtttctctttggaaagtatcaggtgacttggaaggtgagagcctgtccagggtgtgtgcactggttctgaggtaccccgtgtgtgcagtgtgagtcacgggggtgtctgtgttgtgaggtgcttggtaggctttgctctgcccacagtgcagacgcggggtgggtgaggggccaggcccagtgtatgagtggaggcagccccaggctccgcctgcttccctcacgccacgctgcctgagtgtcgccatgctcggaggacagagacctccacggaaactggcagcgccactcacccttccagtgagagctagaaccaagtgccagcccccgggggtgcacccgtgctggtgtggggccacgtggtccttgtggtccaggcagggccagcatgtggcggggtgtccagctccactgtttggaggaagtgggcgctgacacagcagagtgccctgggcccgtggggatttccttccagaggacacgtggctgaaagcataggataaggatgtataggtgaatgactggtgccatccctggctgtctgatagatgcaggtagggcaggtgaactgttgctggcctggccagcaggcctagggtcacatggtgattggcgtcctcctgccaccccttctccatgccagggtgcctgtggtgggtttgcccagcacgcatgaccccaggtcccaaggagagtgtgaactgaggcctgggtggtgaaggcagggcctctcctcagccctgtgtcctgtgggtgccagccagtcccatctcgcattttggggtgccctttccctgctgccaggggactcttcatttgtccttaccctagaatcagcccagacactggacatcacccagacgtggcccttcaggaggtgcacagggcaggggcaggcccgtccctccctgccccaatttgctgggctgcctcagcccagggtctggccttctccttggtgaaggtctgctgggcccctgtccacctcctgctgggaggaggagatggggagaggaccaggaggacaccggaggccctgtcccctgcactgtgagctcagtcaggtccatgagctgcccaccgtcctggccttactgtgccccctgccccaccaacataggtgaaagcacctcccctctaaggaagaccatagagaccccaacactgtgggaccccaaagctccttcatgctcactggagctcccaccgtgggtgcttgcaagtcctcagcgctcccggggtacagccctccccttcctgccctctaatgtcctcccctcccttgcccttccctccacttcctttctctgccgtcccctcctctcccatcttgtgacctctttactggcggggcctggagcccatgatggacacttgcggaaggaggggtggcggagcacccctgagatgacatcgctgcctgccccagagcaccccgcctctccctgtgactcagttctttgcagcccagatgtgagcatgtgcaccctgggacctgctgcccgttgggatgcccaggccaaatcagcccctctgcctccatgctgcactgattgcaagagtttcccacatctgcagaggccgtgggctcagccccacaccagccaggccaccagtgttgatagcggtgaggcggggacaaagggaatgtctcagttcacagtgtggacatggtggaggtctcggccttgcgagacaaggcagggggaggggataggaaattgggggtattctgtgactcctgggccaccggggagccagaatcttccagccagactggatgggcagggcttagcttcctgatgccgcccattcaccactttcaccccgggaacctacctgggcatcatgggaggcagagcctgaaccccaacccaaccctaactctaatgctaacccctaaaccatcccccaccctaacccaatcctcgccctaaccctaatgctaacccctgacccgacccaatcctaaccctgatgctaacccctgactcaactctcaccctaaccctgatgctaacccctgacccaatcctcaccctaaccctgatactaacccttaacctaacccaacccagccctaactccaactctaaagctaactcctaaccctaggagaggagcccaggccgggccctctccctgctggtttcctgttgggctttggagccccagatgcctgcccagaggcttccttgtgcggggtggggtccagcagtgggggatgggcccagagctggtatagccaccagcagagccatcctgatccacaggaccatccctggtggggtggggccccctggggcaggaaggccactgaggccagggagactcccaggcccactcacggcgcaggccccacaggagctggctggaggctatgggtgcggggcgtgggcctgccgggggttgcgtgacaggcagtggggagtgggttgtgctggcagctgtgggtgagtgaggaggctcctctcatgaagggccctggggaagtggaatctggccctgagagacccccggcctcctctgcaggggctgctggcaggaggggaaccggggaccacctcccgccacagagcctggggcccccagccttgcctacagggagggtagatgagagtgtaaactgcatatgaggttgggctaaacctggacatgtgtttcataaccaaagcagccaggaatctccggctctgcccagtgatcatctgggcaggacatggggacgagtgtccaggctgaagtcagggcccggccagcagagggccattttgtattgagctccacagctggtcacattctgtggaatgtgcagacgtgcacggcccatcagacagggtctggagtggggctgccgtcttgggcagctcctcccgggtgtctgcaaaatgcagaggtcaccagagccaaggcagcaaggcaaggagcccggcttctaaggaactctgagcaggtgtggtccatggctgggaggcagctggccccacagcacatagcacggagggcggcgcggagtcctggacgctcttggcaggtcccctcatggaggatgtgggggattggcttaggcctggtctggctggccttcctggaccgcagtggccaggagctgaaaaccgtgaccccagtctccctgcagctgttcttgatgggatttctgttcgccagtcagatgcatttgcacaggacttggatcctgaactgtgtaacctggagaggcaggtgtgagcgggccatgctgctggcccagcctgtgccggtgtctgtttctgttgtctctcggcccttctgtgagccctcagtaaagctcttcgtgcttcagtca

SEQ ID NO: 148018 - DNA, 923 bp, Homo sapiens
  Payload ID: 9294
  Gene Symbol: LRRC30
  Gene Name: leucine rich repeat containing 30
  Uniprot ID: A6NM36
  ENST ID: ENST00000383467
  CDS Start-End: 15-920
gaagggaaggtacaatgggggccaggcagtcaagggccagctccaaggataagggccccaagaggatgctgttcacggggaggagacagaagttttctccgtgggacgatgccctgctctcgggaagggacccgcggtccctgctgaagcggggcatgcaccacgtcagcttcagcctggtcacgagaggaatgacagacatccccgactttctgtggggcttgtccgaggtccagaaactcaatctgtctcacaaccagctccgggttctccctcccgaggtggggaaactgacccggatcgtggtcctgaacttgtgcgggaaccgcctgaagagcctgcccagagaagtgagcctcctacagtgcctcaaggtcctgtttgtcaacatgaactgcctgacagaggtgccggccgagctgagcttgtgccgaaagctggaggtcctgagcttgtcgcacaactgcctgtcccagctccctgcatgcttcgccgacctctctagactgaggaagctaaacctcagcaacaacttcttcgcgcacatccccatgtgtgtgttctccctgaaggaactgattttcttgcacgtgggctcgaatcgcctggaaaacatcgctgagagcatccagcacctggccagcctgcagatcttcatcgcagagggcaacaacatccactccttcccgaggtcgctttgcctggtcaccagcctggagctgctgaacctcaacaacaatgacatccagaccctcccgagcgaactccacctgctgtgtagactggtgaggatcgcctggaatcccatggacaaagggctccacatttcccacaaccctttatccaagcctctgccggagctggtggaggggggcctggagatgctcttcggctacctgaaggacaaaaaacacacctgacct

SEQ ID NO: 148019 - DNA, 2355 bp, Homo sapiens
  Payload ID: 9295
  Gene Symbol: LRRC31
  Gene Name: leucine rich repeat containing 31
  Uniprot ID: Q6UY01
  ENST ID: ENST00000264676
  CDS Start-End: 124-1614
tgtaggggaggatattttgattgaacacaggcttgacagaatcttcttttcttcttagaaatcctagaaaacagaaagcaacaggaagatgtcttattgggaactacccccatcaacttcaccatgagtcaaacaaggaagaaaacttcctcagaaggagaaactaagccccagacttcaactgtcaacaaatttctcaggggctccaatgctgaaagcagaaaagaggacaatgaccttaaaacaagtgattcccaacccagcgactggatacagaagacagccacctcagagactgctaagcctctcagttcagaaatggaatggagatccagtatggagaaaaatgagcatttcctgcagaagctgggcaaaaaggctgtcaacaagtgtctagatttgaataactgtggattaacaacagcggacatgaaagaaatgggagaagcatttgagatgattcctgaacttgaagagctaaatttgtcttggaacagtaaagtgggaggaaatttgcctctgatccttcagaagttccaaaaagggagcaagatacaaatgattgagcttgtggattgctccctcacgtcagaagatgggacatttctgggtcaactgctacctatgctgcaaagtctcgaagtacttgatctttccattaacagagacattgttggcagtctgaacagtattgctcagggattaaaaagcacctcaaatctgaaagtactgaagttacattcatgtggattatcacaaaagagtgtcaaaatattggatgctgcttttaggtatttgggtgagctgaggaaattagatctttcctgcaataaggatctaggtggaggttttgaagactcgccggctcagttggtcatgctaaagcatctacaagtcctagatcttcaccagtgctcactaacagcagatgacgtgatgtcactgacccaggtcattcctttactttcaaatcttcaagaattggatttatcagccaacaaaaagatgggcagttcttctgaaaacttactcagcaggctccgatttttaccagcattgaagtcattagttatcaacaactgtgctttggagagtgagacttttacagctcttgctgaagcctctgttcacctctctgctctggaagtattcaacctttcttggaacaagtgtgttggtggcaacttgaagctgcttctggaaacactaaagctttccatgtctcttcaagtgctgaggctgagcagctgttccctggtgacagaggatgtggctctcctggcatcggtcatacagacgggtcatctggccaaactgcaaaagctggacctgagctacaatgacagcatctgtgatgcggggtggaccatgttctgccaaaacgtgcggttcctcaaagagctaatcgagctggatattagccttcgaccatcaaattttcgagattgtggacaatggtttagacacttgttatatgctgtgaccaagcttcctcagatcactgagataggaatgaaaagatggattctcccagcttcacaggaggaagaactagaatgctttgaccaagataaaaaaagaagcattcactttgaccatggtgggtttcagtaaactgatttcccatgtcctactaagctacaaaccattctccaaaggaaaagaacatgaacgaattccagagtcatgaactgaatttcaacttctgggccatttaatgggacttatattacaagagctttgtaaatatatatatatattacatatatatatgtaatatacatatatacacatatatataatatacatatataatacacatatatatgtaaatatatatataatatctaatatgagcatgccattattctctgtctatgaaacaaaaatggcatttttcaatggatttgttttggatatataattagttcatttgctgtttagaagccttgccaaaagtgtttagattttggtactgcaactgctttcctcttgcccagaaatgttttgcctcttcttttcctacaagttaaatgttctaaatataaaggggtatgtgtgtgtgtgtgtaattctaatgtgaaaggcactagctgtctaatagtttcatgtatcattactattactatatgtatcttaatgtagtctatgtaggtttttatcagaaagtgtacctttctatggtttattattttatattctggtgccttttatctcagatataaaccatgaacagtaatgatagtcactgacatataaatcttagtaaaaagtgattaaaaatctaaaactcagtatgaaaaacatatcttgttagaataaattaaaaccttttattgtttaaaaaattgttaa

SEQ ID NO: 148020 - DNA, 2520 bp, Homo sapiens
  Payload ID: 9295
  Gene Symbol: LRRC31
  Gene Name: leucine rich repeat containing 31
  Uniprot ID: Q6UY01
  ENST ID: ENST00000316428
  CDS Start-End: 59-1717
agaaaacagaaagcaacaggaagatgtcttattgggaactacccccatcaacttcaccatgagtcaaacaaggaagaaaacttcctcagaaggagaaactaagccccagacttcaactgtcaacaaatttctcaggggctccaatgctgaaagcagaaaagaggacaatgaccttaaaacaagtgattcccaacccagcgactggatacagaagacagccacctcagagactgctaagcctctcagttcagaaatggaatggagatccagtatggagaaaaatgagcatttcctgcagaagctgggcaaaaaggctgtcaacaagtgtctagatttgaataactgtggattaacaacagcggacatgaaagaaatggttgccttgctgccttttctcccagacttggaagaactggatatctcctggaatggttttgtaggtggaaccctcctttccatcactcagcaaatgcatctggtcagcaagttaaaaatcttgaggctgggtagctgcagactcaccactgacgatgttcaagcactgggagaagcatttgagatgattcctgaacttgaagagctaaatttgtcttggaacagtaaagtgggaggaaatttgcctctgatccttcagaagttccaaaaagggagcaagatacaaatgattgagcttgtggattgctccctcacgtcagaagatgggacatttctgggtcaactgctacctatgctgcaaagtctcgaagtacttgatctttccattaacagagacattgttggcagtctgaacagtattgctcagggattaaaaagcacctcaaatctgaaagtactgaagttacattcatgtggattatcacaaaagagtgtcaaaatattggatgctgcttttaggtatttgggtgagctgaggaaattagatctttcctgcaataaggatctaggtggaggttttgaagactcgccggctcagttggtcatgctaaagcatctacaagtcctagatcttcaccagtgctcactaacagcagatgacgtgatgtcactgacccaggtcattcctttactttcaaatcttcaagaattggatttatcagccaacaaaaagatgggcagttcttctgaaaacttactcagcaggctccgatttttaccagcattgaagtcattagttatcaacaactgtgctttggagagtgagacttttacagctcttgctgaagcctctgttcacctctctgctctggaagtattcaacctttcttggaacaagtgtgttggtggcaacttgaagctgcttctggaaacactaaagctttccatgtctcttcaagtgctgaggctgagcagctgttccctggtgacagaggatgtggctctcctggcatcggtcatacagacgggtcatctggccaaactgcaaaagctggacctgagctacaatgacagcatctgtgatgcggggtggaccatgttctgccaaaacgtgcggttcctcaaagagctaatcgagctggatattagccttcgaccatcaaattttcgagattgtggacaatggtttagacacttgttatatgctgtgaccaagcttcctcagatcactgagataggaatgaaaagatggattctcccagcttcacaggaggaagaactagaatgctttgaccaagataaaaaaagaagcattcactttgaccatggtgggtttcagtaaactgatttcccatgtcctactaagctacaaaccattctccaaaggaaaagaacatgaacgaattccagagtcatgaactgaatttcaacttctgggccatttaatgggacttatattacaagagctttgtaaatatatatatatattacatatatatatgtaatatacatatatacacatatatataatatacatatataatacacatatatatgtaaatatatatataatatctaatatgagcatgccattattctctgtctatgaaacaaaaatggcatttttcaatggatttgttttggatatataattagttcatttgctgtttagaagccttgccaaaagtgtttagattttggtactgcaactgctttcctcttgcccagaaatgttttgcctcttcttttcctacaagttaaatgttctaaatataaaggggtatgtgtgtgtgtgtgtaattctaatgtgaaaggcactagctgtctaatagtttcatgtatcattactattactatatgtatcttaatgtagtctatgtaggtttttatcagaaagtgtacctttctatggtttattattttatattctggtgccttttatctcagatataaaccatgaacagtaatgatagtcactgacatataaatcttagtaaaaagtgattaaaaatctaaaactcagtatgaaaaacatatcttgttagaataaattaaaaccttttattgtttaaaaaattgttaacatattgcctccaggcatttctttgaaatggaatttgcttcataaaactaatttaattcgtt

SEQ ID NO: 148021 - DNA, 1714 bp, Homo sapiens
  Payload ID: 9295
  Gene Symbol: LRRC31
  Gene Name: leucine rich repeat containing 31
  Uniprot ID: Q6UY01
  ENST ID: ENST00000523069
  CDS Start-End: 27-1358
tgggaactacccccatcaacttcaccatgagtcaaacaaggaagaaaacttcctcagaaggagaaactaagccccagacttcaactgtcaacaaatttctcaggggctccaatgctgaaagcagaaaagaggacaatgaccttaaaacaagtgattcccaacccagcgactggatacagaagacagccacctcagagactgctaagcctctcagttcagaaatggaatggagatccagtatggagaaaaatgagcatttcctgcagaagctgggcaaaaaggctgtcaacaagtgtctagatttgaataactgtggattaacaacagcggacatgaaagaaatggttgccttgctgccttttctcccagacttggaagaactggatatctcctggaatggttttgtaggtggaaccctcctttccatcactcagcaaatgcatctggtcagcaagttaaaaatcttgaggctgggtagctgcagactcaccactgacgatgttcaagcactgggagaagcatttgagatgattcctgaacttgaagagctaaatttgtcttggaacagtaaagtgggaggaaatttgcctctgatccttcagaagttccaaaaagggagcaagatacaaatgattgagcttgtggattgctccctcacgtcagaagatgggacatttctgggtcaactgctacctatgctgcaaagtctcgaagtacttgatctttccattaacagagacattgttggcagtctgaacagtattgctcagggattaaaaagcacctcaaatctgaaagtactgaagttacattcatgtggattatcacaaaagagtgtcaaaatattggatgctgcttttaggtatttgggtgagctgaggaaattagatctttcctgcaataaggatctaggtggaggttttgaagactcgccggctcagttggtcatgctaaagcatctacaagtcctagatcttcaccagtgctcactaacagcagatgacgtgatgtcactgacccaggtcattcctttactttcaaatcttcaagaattggatttatcagccaacaaaaagatgggcagttcttctgaaaacttactcagcaggctccgatttttaccagcattgaagtcattagttatcaacaactgtgctttggagagtgagacttttacagctcttgctgaagcctctgttcacctctctgctctggaagtattcaacctttcttggaacaagtgtgttggtggcaacttgaagctgcttctggaaacactaaagctttccatgtctcttcaagtgctgaggctgagcagctgttccctggtgacagaggatgtggctctcctggagtgattctgttttccagcatcggtcatacagacgggtcatctggccaaactgcaaaagctggacctgagctacaatgacagcatctgtgatgcggggtggaccatgttctgccaaaacgtgcggttcctcaaagagctaatcgagctggatattagccttcgaccatcaaattttcgagattgtggacaatggtttagacacttgttatatgctgtgaccaagcttcctcagatcactgagataggaatgaaaagatggattctcccagcttcacaggaggaagaactagaatgctttgaccaagataaaaaaagaagcattcactttgaccatggtgggtttcagtaaactgatttccc

SEQ ID NO: 148022 - DNA, 4207 bp, Homo sapiens
  Payload ID: 9296
  Gene Symbol: LRRC32
  Gene Name: leucine rich repeat containing 32
  Uniprot ID: Q14392
  ENST ID: ENST00000260061
  CDS Start-End: 139-2127
ggtggggcagctgagcggcctgctcctcctcgggccgtgaccccggggtctggcgcggggtgggacccgggggcgggtttgcgcaaaatgtgccgagactgcccgggagaggagctgcggccgcgctgagccagagccatgagaccccagatcctgctgctcctggccctgctgaccctaggcctggctgcacaacaccaagacaaagtgccctgtaagatggtggacaagaaggtctcgtgccaggttctgggcctgctccaggtcccctcggtgctcccgccagacactgagacccttgatctatctgggaaccagctgcggagtatcctggcctcacccctgggcttctacacagcacttcgtcacctggacctgagcaccaatgagatcagcttcctccagccaggagccttccaggccctgacccacctggagcacctcagcctggctcacaaccggctggcgatggccactgcgctgagtgctggtggcctgggccccctgccacgcgtgacctccctggacctgtctgggaacagcctgtacagcggcctgctggagcggctgctgggggaggcacccagcctgcataccctctcactggcggagaacagtctgactcgcctcacccgccacaccttccgggacatgcctgcgctggagcagcttgacctgcatagcaacgtgctgatggacatcgaggatggcgccttcgagggtctgccccgcctgacccatctcaacctctccaggaattccctcacctgcatctccgacttcagcctccagcagctgcgggtgctagacctgagctgcaacagcatcgaggcctttcagacggcctcccagccccaggctgagttccagctcacctggcttgacctgcgggagaacaaactgctccatttccccgacctggccgcgctcccgagactcatctacctgaacttgtccaacaacctcatccggctccccacagggccaccccaggacagcaagggcatccacgcaccttccgagggctggtcagccctgcccctctcagcccccagcgggaatgccagcggccgccccctttcccagctcttgaatctggatttgagctacaatgagattgagctcatccccgacagctttcttgagcacctgacctccctgtgcttcctgaacctcagcagaaactgcttgcggacctttgaggcccggcgcttaggctccctgccctgcctgatgctccttgacttaagccacaatgccctggagacactggaactgggcgccagagccctggggtctctgcggacgctgctcctacagggcaatgccctgcgggacctgcccccatacacctttgccaatctggccagcctgcagcggctcaacctgcaggggaaccgagtcagcccctgtggggggccagatgagcctggcccctccggctgtgtggccttctccggcatcacctccctccgcagcctgagcctggtggataatgagatagagctgctcagggcaggggccttcctccacaccccactgactgagctggacctttcttccaatcctgggctggaggtggccacgggggccttgggaggcctggaggcctccttggaggtcctggcactgcagggcaacgggctgatggtcctgcaggtggacctgccctgcttcatctgcctcaagcggctcaatcttgccgagaaccgcctgagccaccttcccgcctggacacaggctgtgtcactggaggtgctggacctgcgaaacaacagcttcagcctcctgccaggcagtgccatgggtggcctggagaccagcctccggcgcctctacctgcaggggaatccactcagctgctgcggcaatggctggctggcagcccagctgcaccagggccgtgtggacgtggacgccacccaggacctgatctgccgcttcagctcccaggaggaggtgtccctgagccacgtgcgtcccgaggactgtgagaaggggggactgaagaacatcaacctcatcatcatcctcaccttcatactggtctctgccatcctcctcaccacgctggccgcctgctgctgcgtccgccggcagaagtttaaccaacagtataaagcctaaagaagccgggagacactctaggtcagtgggggagcctgaggtacagagaagagtgaggactgactcaaggtcacacagtgatccgggatcccagaactctggtctccaaattacagcccaggacacctttctctgccgcctgctgcatcagtgggtgacccccttcccgggctgcactttgggtccagctgtggaagccagaagttgggcggtttcagggacagccgagaataatgttgacctgtcagatcaacaaatcttcactgagcatgtattttgtgccacaccctgctctgggcactgggaatgctgggaaatgagatacattcccgccctcaagaatctcccagtctggtaggagagagtgctgcagagccacgtggccgccacgcagtgtgcttagggcctgaggtgtgaaagcccagggctccagagctcggcaggccccgctggtttggtgcggtgagtcctgccccggctgtgccagggtgagggagggccaagcccaggaggatttgtctgagacatttccaagcagactgtttgtcacgtcttctgagaatgactttcagtctctctgaaaatgaaaagcttaggaccagaagagagaattggagctgtacgagtgtgtctcggatctggtgttgttaggtgggccacggcggctccagcagggtctggttaaggggtccagcccagcactggaccattccgtctcctgctctggacttgccctctcccttcctggcactctcatgttgcataccctgaccccagtgctgctctaagcaccgtccctgcccagccccacttctccatcgcagccccaccttggctgctgagccaggagctaaaaccttagatatctggttctgttttgcacccagcttggcagatgtggatttgaatccaagccttgtgtctgcccctatgtgacagctctatattttatccccgttttataaaagaggaaactgaagttctgaaaatctccttccagggccccagctaactaatgccataggtgagattcaaaccttcatccttctgtctccagggcctgatctttaccactgcaggggctgcaggccgttaagtggacaggaagtggccccacatagcccgagcagggtctggaagcatcctgtgctgtgcacacctgctctctcctctctcccaggcaggcagctgcaggcgctctcctccttctctgcctgtttccctcctcccttcctttccaccctggtgtgggttctcctgttctctctgtgctcttgcattctctcattcccttttcctctattgagcagagcctggagtttgagactatggaatccaacctccccattgcacagatggggaaactgaggcttaggaagagaatgaaacttgtggagagcttatacagagcctctgggggaaaaaagagcccttatttgtggggtgagattgggggttggaccagagtgatgtcctctctcagctatcacatcacaagataatgctggctccaaacttcctttctgtgcctcatcatgcaaggatcttttttccctcttacaaaaacaggtaaaaagcctcacccagatgacccccatccctcataccatggagtcatgagctgtctgggaagaatggacgtgctgggaccaactcaagaccttgttttgctgtcttcatcatcttacctgtgcttggcccacagtctggctcatgatgtgggctcagtaatgtgcgagaaagtgaaaatgccactctctccaccccattttacagaggagaacaccaaggcccagaggaagttaagggagagtcaatgggcagagccagggctaggccctggtggtgtgtggagcacccaggcagacccagtcctggttgggatcacacccacgggtgctactgcacgtaacactcctccttaggcctggaggccaaggtgtgggtccccacgcctgatctttgaaaacactacacagggctgctgtcacttcccagggcccaggcctcagcccaggcctcgggaccaactctttgtataacctacctgaatgtattaaaaactaattttggagaagca

SEQ ID NO: 148023 - DNA, 4311 bp, Homo sapiens
  Payload ID: 9296
  Gene Symbol: LRRC32
  Gene Name: leucine rich repeat containing 32
  Uniprot ID: Q14392
  ENST ID: ENST00000407242
  CDS Start-End: 244-2232
gtccgcagcagctctcccaggaccccactctgccagtaagtcagctgaggccgagaggagggagagaggacctcagaggccagactgtgagctagtctgccctgctcctgcgtgtgaggggtcgttggcagggcttagggaaggagaccttgatttggtatagtgggaacatttgctttggagacagatgaactggattctgatcgtgaccctgctattttctccttgtgtgactttggagccatgagaccccagatcctgctgctcctggccctgctgaccctaggcctggctgcacaacaccaagacaaagtgccctgtaagatggtggacaagaaggtctcgtgccaggttctgggcctgctccaggtcccctcggtgctcccgccagacactgagacccttgatctatctgggaaccagctgcggagtatcctggcctcacccctgggcttctacacagcacttcgtcacctggacctgagcaccaatgagatcagcttcctccagccaggagccttccaggccctgacccacctggagcacctcagcctggctcacaaccggctggcgatggccactgcgctgagtgctggtggcctgggccccctgccacgcgtgacctccctggacctgtctgggaacagcctgtacagcggcctgctggagcggctgctgggggaggcacccagcctgcataccctctcactggcggagaacagtctgactcgcctcacccgccacaccttccgggacatgcctgcgctggagcagcttgacctgcatagcaacgtgctgatggacatcgaggatggcgccttcgagggtctgccccgcctgacccatctcaacctctccaggaattccctcacctgcatctccgacttcagcctccagcagctgcgggtgctagacctgagctgcaacagcatcgaggcctttcagacggcctcccagccccaggctgagttccagctcacctggcttgacctgcgggagaacaaactgctccatttccccgacctggccgcgctcccgagactcatctacctgaacttgtccaacaacctcatccggctccccacagggccaccccaggacagcaagggcatccacgcaccttccgagggctggtcagccctgcccctctcagcccccagcgggaatgccagcggccgccccctttcccagctcttgaatctggatttgagctacaatgagattgagctcatccccgacagctttcttgagcacctgacctccctgtgcttcctgaacctcagcagaaactgcttgcggacctttgaggcccggcgcttaggctccctgccctgcctgatgctccttgacttaagccacaatgccctggagacactggaactgggcgccagagccctggggtctctgcggacgctgctcctacagggcaatgccctgcgggacctgcccccatacacctttgccaatctggccagcctgcagcggctcaacctgcaggggaaccgagtcagcccctgtggggggccagatgagcctggcccctccggctgtgtggccttctccggcatcacctccctccgcagcctgagcctggtggataatgagatagagctgctcagggcaggggccttcctccacaccccactgactgagctggacctttcttccaatcctgggctggaggtggccacgggggccttgggaggcctggaggcctccttggaggtcctggcactgcagggcaacgggctgatggtcctgcaggtggacctgccctgcttcatctgcctcaagcggctcaatcttgccgagaaccgcctgagccaccttcccgcctggacacaggctgtgtcactggaggtgctggacctgcgaaacaacagcttcagcctcctgccaggcagtgccatgggtggcctggagaccagcctccggcgcctctacctgcaggggaatccactcagctgctgcggcaatggctggctggcagcccagctgcaccagggccgtgtggacgtggacgccacccaggacctgatctgccgcttcagctcccaggaggaggtgtccctgagccacgtgcgtcccgaggactgtgagaaggggggactgaagaacatcaacctcatcatcatcctcaccttcatactggtctctgccatcctcctcaccacgctggccgcctgctgctgcgtccgccggcagaagtttaaccaacagtataaagcctaaagaagccgggagacactctaggtcagtgggggagcctgaggtacagagaagagtgaggactgactcaaggtcacacagtgatccgggatcccagaactctggtctccaaattacagcccaggacacctttctctgccgcctgctgcatcagtgggtgacccccttcccgggctgcactttgggtccagctgtggaagccagaagttgggcggtttcagggacagccgagaataatgttgacctgtcagatcaacaaatcttcactgagcatgtattttgtgccacaccctgctctgggcactgggaatgctgggaaatgagatacattcccgccctcaagaatctcccagtctggtaggagagagtgctgcagagccacgtggccgccacgcagtgtgcttagggcctgaggtgtgaaagcccagggctccagagctcggcaggccccgctggtttggtgcggtgagtcctgccccggctgtgccagggtgagggagggccaagcccaggaggatttgtctgagacatttccaagcagactgtttgtcacgtcttctgagaatgactttcagtctctctgaaaatgaaaagcttaggaccagaagagagaattggagctgtacgagtgtgtctcggatctggtgttgttaggtgggccacggcggctccagcagggtctggttaaggggtccagcccagcactggaccattccgtctcctgctctggacttgccctctcccttcctggcactctcatgttgcataccctgaccccagtgctgctctaagcaccgtccctgcccagccccacttctccatcgcagccccaccttggctgctgagccaggagctaaaaccttagatatctggttctgttttgcacccagcttggcagatgtggatttgaatccaagccttgtgtctgcccctatgtgacagctctatattttatccccgttttataaaagaggaaactgaagttctgaaaatctccttccagggccccagctaactaatgccataggtgagattcaaaccttcatccttctgtctccagggcctgatctttaccactgcaggggctgcaggccgttaagtggacaggaagtggccccacatagcccgagcagggtctggaagcatcctgtgctgtgcacacctgctctctcctctctcccaggcaggcagctgcaggcgctctcctccttctctgcctgtttccctcctcccttcctttccaccctggtgtgggttctcctgttctctctgtgctcttgcattctctcattcccttttcctctattgagcagagcctggagtttgagactatggaatccaacctccccattgcacagatggggaaactgaggcttaggaagagaatgaaacttgtggagagcttatacagagcctctgggggaaaaaagagcccttatttgtggggtgagattgggggttggaccagagtgatgtcctctctcagctatcacatcacaagataatgctggctccaaacttcctttctgtgcctcatcatgcaaggatcttttttccctcttacaaaaacaggtaaaaagcctcacccagatgacccccatccctcataccatggagtcatgagctgtctgggaagaatggacgtgctgggaccaactcaagaccttgttttgctgtcttcatcatcttacctgtgcttggcccacagtctggctcatgatgtgggctcagtaatgtgcgagaaagtgaaaatgccactctctccaccccattttacagaggagaacaccaaggcccagaggaagttaagggagagtcaatgggcagagccagggctaggccctggtggtgtgtggagcacccaggcagacccagtcctggttgggatcacacccacgggtgctactgcacgtaacactcctccttaggcctggaggccaaggtgtgggtccccacgcctgatctttgaaaacactacacagggctgctgtcacttcccagggcccaggcctcagcccaggcctcgggaccaactctttgtataacctacctgaatgtattaaaaactaattttggagaagc

SEQ ID NO: 148024 - DNA, 2656 bp, Homo sapiens
  Payload ID: 9296
  Gene Symbol: LRRC32
  Gene Name: leucine rich repeat containing 32
  Uniprot ID: Q14392
  ENST ID: ENST00000404995
  CDS Start-End: 139-2127
ggtggggcagctgagcggcctgctcctcctcgggccgtgaccccggggtctggcgcggggtgggacccgggggcgggtttgcgcaaaatgtgccgagactgcccgggagaggagctgcggccgcgctgagccagagccatgagaccccagatcctgctgctcctggccctgctgaccctaggcctggctgcacaacaccaagacaaagtgccctgtaagatggtggacaagaaggtctcgtgccaggttctgggcctgctccaggtcccctcggtgctcccgccagacactgagacccttgatctatctgggaaccagctgcggagtatcctggcctcacccctgggcttctacacagcacttcgtcacctggacctgagcaccaatgagatcagcttcctccagccaggagccttccaggccctgacccacctggagcacctcagcctggctcacaaccggctggcgatggccactgcgctgagtgctggtggcctgggccccctgccacgcgtgacctccctggacctgtctgggaacagcctgtacagcggcctgctggagcggctgctgggggaggcacccagcctgcataccctctcactggcggagaacagtctgactcgcctcacccgccacaccttccgggacatgcctgcgctggagcagcttgacctgcatagcaacgtgctgatggacatcgaggatggcgccttcgagggtctgccccgcctgacccatctcaacctctccaggaattccctcacctgcatctccgacttcagcctccagcagctgcgggtgctagacctgagctgcaacagcatcgaggcctttcagacggcctcccagccccaggctgagttccagctcacctggcttgacctgcgggagaacaaactgctccatttccccgacctggccgcgctcccgagactcatctacctgaacttgtccaacaacctcatccggctccccacagggccaccccaggacagcaagggcatccacgcaccttccgagggctggtcagccctgcccctctcagcccccagcgggaatgccagcggccgccccctttcccagctcttgaatctggatttgagctacaatgagattgagctcatccccgacagctttcttgagcacctgacctccctgtgcttcctgaacctcagcagaaactgcttgcggacctttgaggcccggcgcttaggctccctgccctgcctgatgctccttgacttaagccacaatgccctggagacactggaactgggcgccagagccctggggtctctgcggacgctgctcctacagggcaatgccctgcgggacctgcccccatacacctttgccaatctggccagcctgcagcggctcaacctgcaggggaaccgagtcagcccctgtggggggccagatgagcctggcccctccggctgtgtggccttctccggcatcacctccctccgcagcctgagcctggtggataatgagatagagctgctcagggcaggggccttcctccacaccccactgactgagctggacctttcttccaatcctgggctggaggtggccacgggggccttgggaggcctggaggcctccttggaggtcctggcactgcagggcaacgggctgatggtcctgcaggtggacctgccctgcttcatctgcctcaagcggctcaatcttgccgagaaccgcctgagccaccttcccgcctggacacaggctgtgtcactggaggtgctggacctgcgaaacaacagcttcagcctcctgccaggcagtgccatgggtggcctggagaccagcctccggcgcctctacctgcaggggaatccactcagctgctgcggcaatggctggctggcagcccagctgcaccagggccgtgtggacgtggacgccacccaggacctgatctgccgcttcagctcccaggaggaggtgtccctgagccacgtgcgtcccgaggactgtgagaaggggggactgaagaacatcaacctcatcatcatcctcaccttcatactggtctctgccatcctcctcaccacgctggccgcctgctgctgcgtccgccggcagaagtttaaccaacagtataaagcctaaagaagccgggagacactctaggtaaaaagcctcacccagatgacccccatccctcataccatggagtcatgagctgtctgggaagaatggacgtgctgggaccaactcaagaccttgttttgctgtcttcatcatcttacctgtgcttggcccacagtctggctcatgatgtgggctcagtaatgtgcgagaaagtgaaaatgccactctctccaccccattttacagaggagaacaccaaggcccagaggaagttaagggagagtcaatgggcagagccagggctaggccctggtggtgtgtggagcacccaggcagacccagtcctggttgggatcacacccacgggtgctactgcacgtaacactcctccttaggcctggaggccaaggtgtgggtccccacgcctgatctttgaaaacactacacagggctgctgtcacttcccagggcccaggcctcagcccaggcctcgggaccaactctttgtataacctacctgaatgtattaaaaactaattttggagaa

SEQ ID NO: 148025 - DNA, 801 bp, Homo sapiens
  Payload ID: 9296
  Gene Symbol: LRRC32
  Gene Name: leucine rich repeat containing 32
  ENST ID: ENST00000421973
  CDS Start-End: 244-801
gtccgcagcagctctcccaggaccccactctgccagtaagtcagctgaggccgagaggagggagagaggacctcagaggccagactgtgagctagtctgccctgctcctgcgtgtgaggggtcgttggcagggcttagggaaggagaccttgatttggtatagtgggaacatttgctttggagacagatgaactggattctgatcgtgaccctgctattttctccttgtgtgactttggagccatgagaccccagatcctgctgctcctggccctgctgaccctaggcctggctgcacaacaccaagacaaagtgccctgtaagatggtggacaagaaggtctcgtgccaggttctgggcctgctccaggtcccctcggtgctcccgccagacactgagacccttgatctatctgggaaccagctgcggagtatcctggcctcacccctgggcttctacacagcacttcgtcacctggacctgagcaccaatgagatcagcttcctccagccaggagccttccaggccctgacccacctggagcacctcagcctggctcacaaccggctggcgatggccactgcgctgagtgctggtggcctgggccccctgccacgcgtgacctccctggacctgtctgggaacagcctgtacagcggcctgctggagcggctgctgggggaggcacccagcctgcataccctctcactggcggagaacagtctgactcgcctcacccgccacaccttccgggacatgcctgcgctggagcagcttgacctgcatagcaacgtgctgatg

SEQ ID NO: 148026 - DNA, 1718 bp, Homo sapiens
  Payload ID: 9297
  Gene Symbol: LRRC34
  Gene Name: leucine rich repeat containing 34
  Uniprot ID: Q8IZ02
  ENST ID: ENST00000446859
  CDS Start-End: 117-1511
agtgaggcctcagggcccgggcaggcacagccagcgggactcgaagcaggctggcgccgaggctcgtgtagccgcctcacagctgcaggcggactgtaagtgcgcgcgcggtcgccatggcagcgcagccgccgcggccagtgggtgagaggagcatggggagctcccgggaggccgcccgtgcgccggccaggtccccggcttgggcctccactcaggccagtactccgggcgcggccctggcggtccagcgcgaatctccagaatctggtctccagaaacattattctaatctgtgtatggaaaaatcccagaaaattaatccttttatattgcatatactccaagaagtggatgaagaaattaaaaaggggctagcagcaggaatcacattaaacattgctggtaacaatcgcttagtgccagtagaaagagttacaggtgaagatttttggattctttccaaaattttaaagaattgtctgtatattaatggtttggatgttggatataaccttctatgtgatgttggtgcatactatgctgcgaaactgcttcagaaacaacttaatctcatttacttaaacctcatgtttaatgatattgggcccgaaggtggagaattgattgctaaagtgctacataagaatcggactctgaaatacctaagaatgactggaaacaaaattgaaaataaaggtggaatgttttttgctgcaatgctgcaaattaattcatcattagagaaattagatctgggtgactgtgatctgggaatgcaaagtgtgatagcatttgctacagtactaactcaaaaccaagcaattaaggcaataaacctaaaccgacctatactgtacagtgaacaggaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctgcaacaaaataactcatgatggaatggtgtatttggctgatgtactgaaaagcaacactaccctggaagtaatagatctttcctttaacagaatagaaaatgcaggcgcaaactatctcagtgaaactcttacttcacacaacaggagtcttaaagcgttgtcagtagtcagcaacaacatagagggagaaggacttgttgcactttcacaatcaatgaaaacaaatctcactttctctcatatctacatttggggaaacaaatttgatgaggctacgtgtatagcatattcagacttaattcaaatgggttgtctaaaaccagacaatacagatgtggagccatttgtggtagatggacgtgtatatcttgcagaagtctccaatggccttaaaaagcattattattggacatcaacttatggagaatcttatgaccactcatctaatgcaggttttgctcttgttccagtaggtcaacagccatgaaaaagtagctgtaaaataattttcatacacttgtcttattgtttcacagagattaatattctatagcctattttcttttataaattaaaacaagttacttttttcaaatgtgtaaaagataatgactgtattaaactttgtataactgtctattgtgaaaaactgagtagggtaattttttaaaagaaattttacaatatagagact

SEQ ID NO: 148027 - DNA, 1899 bp, Homo sapiens
  Payload ID: 9297
  Gene Symbol: LRRC34
  Gene Name: leucine rich repeat containing 34
  Uniprot ID: Q8IZ02
  ENST ID: ENST00000522526
  CDS Start-End: 439-1737
agatgtcacctccttcaggaagccctccctggtggccccgccctttgggagcacaaaaccctttatgctcccaaagcccaacgcctttatcatgtgctgatgctactctgcttcttcgctggcccggcaggccggtgcacactttgtaggagcgggctttgtcataatcttctttgtagccccagccctagctcagcagcggagcccctcaaacctcgggaactcctccctgcaaaggagccaggacgccctccctcaggctgcctttaaccagggcagggtgacaaaggacctccacagagtaggcggtcactgccttagcagtgaggcctcagggcccgggcaggcacagccagcgggactcgaagcaggctggcgccgaggctcgtgtagccgcctcacagctgcaggcggactgtaagtgcgcgcgcggtcgccatggcagcgcagccgccgcggccagtgggtgagaggagcatggggagctcccgggaggccgcccgtgcgccggccaggtccccggcttgggcctccactcaggccagtactccgggcgcggccctggcggtccagcgcgaatctccagaatctggtctccagaaacattattctaatctgtgtatggaaaaatcccagaaaattaatccttttatattgcatatactccaagaagtggatgaagaaattaaaaaggggctagcagcaggaatcacattaaacattgctggtaacaatcgcttagtgccagtagaaagagttacaggtgaagatttttggattctttccaaaattttaaagaattgtctgtatattaatggtttggatgttggatataaccttctatgtgatgttggtgcatactatgctgcgaaactgcttcagaaacaacttaatctcatttacttaaacctcatgtttaatgatattgggcccgaaggtggagaattgattgctaaagtgctacataagaatcggactctgaaatacctaagaatgactggaaacaaaattgaaaataaaggtggaatgttttttgctgcaatgctgcaaattaattcatcattagagaaattagatctgggtgactgtgatctggaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctgcaacaaaataactcatgatggaatggtgtatttggctgatgtactgaaaagcaacactaccctggaagtaatagatctttcctttaacagaatagaaaatgcaggcgcaaactatctcagtgaaactcttacttcacacaacaggagtcttaaagcgttgtcagtagtcagcaacaacatagagggagaaggacttgttgcactttcacaatcaatgaaaacaaatctcactttctctcatatctacatttggggaaacaaatttgatgaggctacgtgtatagcatattcagacttaattcaaatgggttgtctaaaaccagacaatacagatgtggagccatttgtggtagatggacgtgtatatcttgcagaagtctccaatggccttaaaaagcattattattggacatcaacttatggagaatcttatgaccactcatctaatgcaggttttgctcttgttccagtaggtcaacagccatgaaaaagtagctgtaaaataattttcatacacttgtcttattgtttcacagagattaatattctatagcctattttcttttataaattaaaacaagttacttttttcaaatgtgtaaaagataatgactgtattaaactttgtataactgtctattgtgaaaaa

SEQ ID NO: 148028 - DNA, 1781 bp, Homo sapiens
  Payload ID: 9297
  Gene Symbol: LRRC34
  Gene Name: leucine rich repeat containing 34
  ENST ID: ENST00000522830
  CDS Start-End: 408-1619
aaaaccctttatgctcccaaagcccaacgcctttatcatgtgctgatgctactctgcttcttcgctggcccggcaggccggtgcacactttgtaggagcgggctttgtcataatcttctttgtagccccagccctagctcagcagcggagcccctcaaacctcgggaactcctccctgcaaaggagccaggacgccctccctcaggctgcctttaaccagggcagggtgacaaaggacctccacagagtaggcggtcactgccttagcagtgaggcctcagggcccgggcaggcacagccagcgggactcgaagcaggctggcgccgaggctcgtgtagccgcctcacagctgcaggcggactaatctccagaatctggtctccagaaacattattctaatctgtgtatggaaaaatcccagaaaattaatccttttatattgcatatactccaagaagtggatgaagaaattaaaaaggggctagcagcaggaatcacattaaacattgctggtaacaatcgcttagtgccagtagaaagagttacaggtgaagatttttggattctttccaaaattttaaagaattgtctgtatattaatggtttggatgttggatataaccttctatgtgatgttggtgcatactatgctgcgaaactgcttcagaaacaacttaatctcatttacttaaacctcatgtttaatgatattgggcccgaaggtggagaattgattgctaaagtgctacataagaatcggactctgaaatacctaagaatgactggaaacaaaattgaaaataaaggtggaatgttttttgctgcaatgctgcaaattaattcatcattagagaaattagatctgggtgactgtgatctgggaatgcaaagtgtgatagcatttgctacagtactaactcaaaaccaagcaattaaggcaataaacctaaaccgacctatactgtacagtgaacaggaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctgcaacaaaataactcatgatggaatggtgtatttggctgatgtactgaaaagcaacactaccctggaagtaatagatctttcctttaacagaatagaaaatgcaggcgcaaactatctcagtgaaactcttacttcacacaacaggagtcttaaagcgttgtcagtagtcagcaacaacatagagggagaaggacttgttgcactttcacaatcaatgaaaacaaatctcactttctctcatatctacatttggggaaacaaatttgatgaggctacgtgtatagcatattcagacttaattcaaatgggttgtctaaaaccagacaatacagatgtggagccatttgtggtagatggacgtgtatatcttgcagaagtctccaatggccttaaaaagcattattattggacatcaacttatggagaatcttatgaccactcatctaatgcaggttttgctcttgttccagtaggtcaacagccatgaaaaagtagctgtaaaataattttcatacacttgtcttattgtttcacagagattaatattctatagcctattttcttttataaattaaaacaagttacttttttcaaatgtgtaaaagataatgactgtattaaactttgtataactgtctattgtgaaaaa

SEQ ID NO: 148029 - DNA, 467 bp, Homo sapiens
  Payload ID: 9297
  Gene Symbol: LRRC34
  Gene Name: leucine rich repeat containing 34
  ENST ID: ENST00000528597
  CDS Start-End: 1-171
gaagagtctacagtccatgtaggccgcatgttgaaagaaaatcactgtcttgttgcactacacatgtgtaagcatgatataaaaaacagtggtatacaacagttatgtgatgcactgtatctgaacagtagcctgcgctaccttgatgtcagctggcatattcagacttaattcaaatgggttgtctaaaaccagacaatacagatgtggagccatttgtggtagatggacgtgtatatcttgcagaagtctccaatggccttaaaaagcattattattggacatcaacttatggagaatcttatgaccactcatctaatgcaggttttgctcttgttccagtaggtcaacagccatgaaaaagtagctgtaaaataattttcatacacttgtcttattgtttcacagagattaatattctatagcctattttcttttataaattaaaacaagttacttttttcaaa

SEQ ID NO: 148030 - DNA, 2395 bp, Homo sapiens
  Payload ID: 9298
  Gene Symbol: LRRC36
  Gene Name: leucine rich repeat containing 36
  Uniprot ID: Q1X8D7
  ENST ID: ENST00000329956
  CDS Start-End: 20-2284
aggtgagcggcgggcggggatggcggagcaatgggagctggacgaggaaggcattcgccgcctgggggcgctgacgctggagcagccggaactggtggagtctctttcattgcagggatcttatgctggcaaaatccattccattggtgatgccttcagaaattttaaaaatctccgatccttagatttatcaaggaatttgatcactagccttaagggaatccagtatttatgttcactccaagacctgaatttatattataacaacattccttcattagtggaagtgtcccgtctacaaccgttacccttcctcaaagaactggatttgagacttaatcctgttgtaaggaaagatacagattataggctctttgctgtatatacactacaaactctggagaaattagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggacacagacacaggaagtagcaagaagggagatgccaagtgacaatcaccaggaagatgagttcagacactactcgcctcgtcagtccacagtccgatccccagagaagatgactagagaagggtaccaagtatcttttttggacaataagtcttcaggttcttctccagaaaaggaattgataccaaaacctgatacttttcatcttacccatgatgcctcattgagtaaatgcctggatgtgggtgattctagccagatccatccctatcagttaccttcagatgttggtctggaaaattatgacagttgttattctcaaactctatccctgcatggaagtcttggtaaaaggcctcagagaagcaagaactatcaagagtatagcataaagccttcaaatgacataaagaccaccgcttcacattcctgtggagacttattaacttctctgtcaaaccctgactccagcactggaaggcttttgaagcttagttcagatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgagcctctctctagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggtcctgcccgagatttgcttctgtctttggtagtcccggctccttctcagccgaggtgttgctcacatcctgaagacacgatgaaagcattctgcaggagggagcttgaactgaaggaggctgcgcagctggtccctaatgacatggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctg

SEQ ID NO: 148031 - DNA, 1765 bp, Homo sapiens
  Payload ID: 9298
  Gene Symbol: LRRC36
  Gene Name: leucine rich repeat containing 36
  Uniprot ID: Q1X8D7
  ENST ID: ENST00000435835
  CDS Start-End: 65-1654
tttttcctctgcgaatatggttttctgattaactactagttatgtctatgccaaaaaaagaaacatgctcagaccacggtttttgcctccagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggacacagacacaggaagtagcaagaagggagatgccaagtgacaatcaccaggaagatgagttcagacactactcgcctcgtcagtccacagtccgatccccagagaagatgactagagaagggtaccaagtatcttttttggacaataagtcttcaggttcttctccagaaaaggaattgataccaaaacctgatacttttcatcttacccatgatgcctcattgagtaaatgcctggatgtgggtgattctagccagatccatccctatcagttaccttcagatgttggtctggaaaattatgacagttgttattctcaaactctatccctgcatggaagtcttggtaaaaggcctcagagaagcaagaactatcaagagtatagcataaagccttcaaatgacataaagaccaccgcttcacattcctgtggagacttattaacttctctgtcaaaccctgactccagcactggaaggcttttgaagcttagttcagatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgaggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctg

SEQ ID NO: 148032 - DNA, 572 bp, Homo sapiens
  Payload ID: 9298
  Gene Symbol: LRRC36
  Gene Name: leucine rich repeat containing 36
  ENST ID: ENST00000569552
  CDS Start-End: 92-160
aacacaccaagatgagactggtcctaatttttcctctgcgaatatggttttctgattaactactagttatgtctatgccaaaaaaagaaacatgctcagaccacggtttttgcctccagatgaccgaactgtacgtgaagctctagggagaagacaatgaaaaactgtgtaacaggtgagagctctgcatcaaaagtcagtgctaatgttgacagcaggattgaaatggagttcagacactactcgcctcgtcagtccacagtccgatccccagagaagatgactagagaagggtaccaagtatcttttttggacaataagtcttcaggttcttctccagaaaaggaattgataccaaaacctgatacttttcatcttacccatgatgcctcattgagtaaatgcctggatgtgggtgattctagccagatccatccctatcagttaccttcagatgttggtctggaaaattatgacagttgttattctcaaactctatccctgcatggaagtcttggtaaaaggcctcagagaagcaagaactatcaagagtatagcataaagccttcaaa

SEQ ID NO: 148033 - DNA, 589 bp, Homo sapiens
  Payload ID: 9298
  Gene Symbol: LRRC36
  Gene Name: leucine rich repeat containing 36
  ENST ID: ENST00000570075
  CDS Start-End: 20-136
aggtgagcggcgggcggggatggcggagcaatgggagctggacgaggaaggcattcgccgcctgggggcgctgacgctggagcagccggggaatccagtatttatgttcactccaagacctgaatttatattataacaacattccttcattagtggaagtgtcccgtctacaaccgttacccttcctcaaagaactggatttgagacttaatcctgttgtaaggaaagatacagattataggctctttgctgtatatacactacaaactctggagaaattagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggac

SEQ ID NO: 148034 - DNA, 1387 bp, Homo sapiens
  Payload ID: 9298
  Gene Symbol: LRRC36
  Gene Name: leucine rich repeat containing 36
  ENST ID: ENST00000568010
  CDS Start-End: 100-492
ctgtctctaacacaccaagatgagactggtcctaatttttcctctgcgaatatggttttctgattaactactagttatgtctatgccaaaaaaagaaacatgctcagaccacggtttttgcctccagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggacacagatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtc

SEQ ID NO: 148035 - DNA, 2104 bp, Homo sapiens
  Payload ID: 9298
  Gene Symbol: LRRC36
  Gene Name: leucine rich repeat containing 36
  Uniprot ID: Q1X8D7
  ENST ID: ENST00000563189
  CDS Start-End: 92-1993
aacacaccaagatgagactggtcctaatttttcctctgcgaatatggttttctgattaactactagttatgtctatgccaaaaaaagaaacatgctcagaccacggtttttgcctccagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggacacagacacaggaagtagcaagaagggagatgccaagtgacaatcaccaggaagatgagttcagacactactcgcctcgtcagtccacagtccgatccccagagaagatgactagagaagggtaccaagtatcttttttggacaataagtcttcaggttcttctccagaaaaggaattgataccaaaacctgatacttttcatcttacccatgatgcctcattgagtaaatgcctggatgtgggtgattctagccagatccatccctatcagttaccttcagatgttggtctggaaaattatgacagttgttattctcaaactctatccctgcatggaagtcttggtaaaaggcctcagagaagcaagaactatcaagagtatagcataaagccttcaaatgacataaagaccaccgcttcacattcctgtggagacttattaacttctctgtcaaaccctgactccagcactggaaggcttttgaagcttagttcagatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgagcctctctctagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggtcctgcccgagatttgcttctgtctttggtagtcccggctccttctcagccgaggtgttgctcacatcctgaagacacgatgaaagcattctgcaggagggagcttgaactgaaggaggctgcgcagctggtccctaatgacatggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctg

SEQ ID NO: 148036 - DNA, 1539 bp, Homo sapiens
  Payload ID: 9298
  Gene Symbol: LRRC36
  Gene Name: leucine rich repeat containing 36
  ENST ID: ENST00000567211
  CDS Start-End: 118-186
atagcattattttgtgacctgtctctaacacaccaagatgagactggtcctaatttttcctctgcgaatatggttttctgattaactactagttatgtctatgccaaaaaaagaaacatgctcagaccacggtttttgcctccagatgaccgaactgtacgtgaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggacacagatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgaggcaagtgttggcttgtttgtgtttgtgcgagaaacaggtcaggttcgagaccagaatgagggttctgttgggaatggaggtggttctgaccaacagggctagaaattcaaagagattttcagaggctggtggctaatactgccaagctaacacctgttgagccttctgcccttgggaaagtcattcccccactgctgccattttctcacctatatcacagggagaactgtccctgatctacttccggctgaagattgaactctgtagcatctatgtttacagtctcatcatatttacacatttgcttcggccacacatgaaatagttcttataaaagcattgcttcaggctgggcacagtggcgcatgcctgtaatcccagcactttgggaggctgagtgggtggatcacctcaggtcaggagttcaagaccagccaggccaacatggcgaaaccccatctctactgaaaatacaaaaattagctgggtgtggtggcgcacgcctgtagtgccagctactctactcgggaggctgaggcaggagactcacttgaacccaggaggtggaggttgcagtgagccgagatcacgccactgcactccagcctgggtgacagagtgactcagtttcgtaaaaaataatagtaataaaagcattgctttgcttttctgtctagaagttaaaaggatttaaaatttttttccaatgtagaagcaaacagaagatgaattagattatccaagggatttttagttcagagaatgatttaaaaatcaagaaccattcccacataaacaatatacatgtaattcattttataaaatatcctagtggccaggcacggtggcttacatctgta

SEQ ID NO: 148037 - DNA, 2028 bp, Homo sapiens
  Payload ID: 9298
  Gene Symbol: LRRC36
  Gene Name: leucine rich repeat containing 36
  ENST ID: ENST00000567723
  CDS Start-End: 92-472
aacacaccaagatgagactggtcctaatttttcctctgcgaatatggttttctgattaactactagttatgtctatgccaaaaaaagaaacatgctcagaccacggtttttgcctccagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggaaagagtcttgctctgtcgcccagactggagtgctgtggcgcgatctcggctcactgcaacctctacctcctgggttcaagcagttctcctgcctcagcctagcgagcagctgggattacagactcaaacaaaggactttttattcccttccccaaccgggaaataaaggattccctaagtacttctgcaactcagggcaatggtacacgtgatcagaaattagacaccttcccactggggacacagagttcagacactactcgcctcgtcagtccacagtccgatccccagagaagatgactagagaagggtaccaagtatcttttttggacaataagtcttcaggttcttctccagaaaaggaattgataccaaaacctgatacttttcatcttacccatgatgcctcattgagtaaatgcctggatgtgggtgattctagccagatccatccctatcagttaccttcagatgttggtctggaaaattatgacagttgttattctcaaactctatccctgcatggaagtcttggtaaaaggcctcagagaagcaagaactatcaagagtatagcataaagccttcaaatgacataaagaccaccgcttcacattcctgtggagacttattaacttctctgtcaaaccctgactccagcactggaaggcttttgaagcttagttcagatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgagcctctctctagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctg

SEQ ID NO: 148038 - DNA, 1148 bp, Homo sapiens
  Payload ID: 9298
  Gene Symbol: LRRC36
  Gene Name: leucine rich repeat containing 36
  ENST ID: ENST00000567823
  CDS Start-End: 80-304
tgagactggtcctaatttttcctctgcgaatatggttttctgattaactactagttatgtctatgccaaaaaaagaaacatgctcagaccacggtttttgcctccagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggcctctctctagtgacctgggtagtttgcacggtttggctggaaaccacagtccccccatctctgccagaaccccccatgtggccactgtcctcagacagctcctggagcttgtggataagcactggaatggctccggctccctcctcctcaacaagaagtttctcggtcctgcccgagatttgcttctgtctttggtagtcccggctccttctcagccgaggtgttgctcacatcctgaagacacgatgaaagcattctgcaggagggagcttgaactgaaggaggctgcgcagctggtccctaatgacatggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactca

SEQ ID NO: 148039 - DNA, 210 bp, Homo sapiens
  Payload ID: 9298
  Gene Symbol: LRRC36
  Gene Name: leucine rich repeat containing 36
  ENST ID: ENST00000561948
  CDS Start-End: 18-210
gtgagcggcgggcggggatggcggagcaatgggagctggacgaggaaggcattcgccgcctgggggcgctgacgctggagcagccggactcaaacaaaggactttttattcccttccccaaccgggaaataaaggattccctaagtacttctgcaactcagggcaatggtacacgtgatcagaaattagacaccttcccactggggacac

SEQ ID NO: 148040 - DNA, 562 bp, Homo sapiens
  Payload ID: 9298
  Gene Symbol: LRRC36
  Gene Name: leucine rich repeat containing 36
  ENST ID: ENST00000561821
  CDS Start-End: 79-147
gagactggtcctaatttttcctctgcgaatatggttttctgattaactactagttatgtctatgccaaaaaaagaaacatgctcagaccacggtttttgcctccagatgaccgaactgtacgtgaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggacacagacacaggaagtagcaagaagggagatgccaagtgacaatcaccaggaagatgagttcagacactactcgcctcgtcagtccacagtccgatccccagagaagatgactagagaagggtaccaagtatcttttttggacaataagtcttcaggttcttctccagaaaaggaattgataccaaaacctgatacttttcatcttacccatgatgcctcattgag

SEQ ID NO: 148041 - DNA, 747 bp, Homo sapiens
  Payload ID: 9298
  Gene Symbol: LRRC36
  Gene Name: leucine rich repeat containing 36
  ENST ID: ENST00000569499
  CDS Start-End: 498-747
aggtgagcggcgggcggggatggcggagcaatgggagctggacgaggaaggcattcgccgcctgggggcgctgacgctggagcagccggggatcttatgctggcaaaatccattccattggtgatgccttcagaaattttaaaaatctccgatccttagatttatcaaggaatttgatcactagccttaagggaatccagtatttatgttcactccaagacctgaatttatattataacaacattccttcattagtggaagtgtcccgtctacaaccgttacccttcctcaaagaactggatttgagacttaatcctgttgtaaggaaagatacagattataggctctttgctgtatatacactacaaactctggagaaattagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggacacagacacaggaagtagcaagaagggagatgccaagtgacaatcaccaggaagatg

SEQ ID NO: 148042 - DNA, 596 bp, Homo sapiens
  Payload ID: 9298
  Gene Symbol: LRRC36
  Gene Name: leucine rich repeat containing 36
  ENST ID: ENST00000568804
  CDS Start-End: 508-596
agaagctgtggaaagaaaactgaagtggaaggcggggaacctgagatagaggcgagggaaccacagagaagcgaactggtggagtctctttcattgcagggatcttatgctggcaaaatccattccattggtgatgccttcagaaattttaaaaatctccgatccttagatttatcaaggaatttgatcactagccttaagggaatccagtatttatgttcactccaagacctgaatttatattataacaacattccttcattagtggaagtgtcccgtctacaaccgttacccttcctcaaagaactggatttgagacttaatcctgttgtaaggaaagatacagattataggctctttgctgtatatacactacaaactctggagaaattagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggactcaaacaaaggact

SEQ ID NO: 148043 - DNA, 1888 bp, Homo sapiens
  Payload ID: 9298
  Gene Symbol: LRRC36
  Gene Name: leucine rich repeat containing 36
  ENST ID: ENST00000565019
  CDS Start-End: 1-826
ggacgaggaaggcattcgccgcctgggggcgctgacgctggagcagccggagacaggttcttgctatgttgcccaggctggacttgaacttctggactcaagcaatcctgtctcagcctccccagtaactgagactacagaactggtggagtctctttcattgcagggatcttatgctggcaaaatccattccattggtgatgccttcagaaattttaaaaatctccgatccttagatttatcaaggaatttgatcactagccttaagggaatccagtatttatgttcactccaagacctgaatttatattataacaacattccttcattagtggaagtgtcccgtctacaaccgttacccttcctcaaagaactggatttgagacttaatcctgttgtaaggaaagatacagattataggctctttgctgtatatacactacaaactctggagaaattagatgaccgaactgtacgtgaaggtgagagaaaagctgccaagctgcattttagtcagttgggcaacagtgaaaattttcttttagaggtggaaaaaagctctagggagaagacaatgaaaaactgtgtaacaggtgagagctctgcatcaaaagtcagtgctaatgttgacagcaggattgaaatggactcaaacaaaggactttttattcccttccccaaccgggaaataaaggattccctaagtacttctgcaactcagggcaatggtacacgtgatcagaaattagacaccttcccactggggacacagatctgtatgccacaacccatttcaacagtgaccctgctgtacttgtcaatgtagagcaacaattatctaccagcctggatgatttaacaccagcacatggttctgtcccaaacaacgctgtcctgggaaacaggacaactcctctgcggacactgctgttgtctcctgggacttcagaacacagaaagatttttaccaagaggtcactaagcccatcgaagagaggattcaaatggaaggacaatatccttgccaacctgaatctaaagcatggtttccaagatgctacaggcagcgagaaccccccatgtggccactgtcctcagacagctcctggagcttgtggataagcactggaatggctccggctccctcctcctcaacaagaagtttctcggtcctgcccgagatttgcttctgtctttggtagtcccggctccttctcagccgaggtgttgctcacatcctgaagacacgatgaaagcattctgcaggagggagcttgaactgaaggaggctgcgcagctggtccctaatgacatggaaagtttgaagcaaaaactggtcagagtgctggaggaaaacctcattttgtcagaaaaaattcaacagttggaggaaggtgctgccatctcaattgtgagtgggcaacagtcacatacttatgatgatcttctgcacaaaaaccaacagctgaccatgcaggtggcttgcctgaaccaggagcttgcccagctgaaaaagctggagaagacagttgccattctccatgaaagtcagagatccctggtggtaactaatgagtatctgctgcagcagctgaataaggagccaaaaggttattccgggaaagcgctcctgcctcctgagaagggtcatcatctggggagatcatcgccctttgggaaaagcacgttgtcttcctcctcaccagtggcacatgagactggtcagtatctaatacagagcgtcttggatgctgccccagagcctggcttatagagctagcatggaactcacaccacagcttccctggtccacagaggctctcaccgccattgccaccagtatggtggtatgtactcacaaagattaagaaagaaatgtattctgatt

SEQ ID NO: 148044 - DNA, 5177 bp, Homo sapiens
  Payload ID: 9299
  Gene Symbol: LRRC37A2
  Gene Name: leucine rich repeat containing 37, member A2
  Uniprot ID: A6NM11
  ENST ID: ENST00000333412
  CDS Start-End: 4-5106
agaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccatggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaatgaa

SEQ ID NO: 148045 - DNA, 5669 bp, Homo sapiens
  Payload ID: 9299
  Gene Symbol: LRRC37A2
  Gene Name: leucine rich repeat containing 37, member A2
  Uniprot ID: A6NM11
  ENST ID: ENST00000576629
  CDS Start-End: 496-5598
gctgaagtgcaatgttgtgatctcggctcactgcaacctctgcctcccaggttcaagcgattctcctgctttggcctcctgagtagctgggattgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccatggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaatgaa

SEQ ID NO: 148046 - DNA, 5175 bp, Homo sapiens
  Payload ID: 9299
  Gene Symbol: LRRC37A2
  Gene Name: leucine rich repeat containing 37, member A2
  ENST ID: ENST00000614665
  CDS Start-End: 4-5106
agaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccactttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctgggacccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccacggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaata

SEQ ID NO: 148047 - DNA, 5177 bp, Homo sapiens
  Payload ID: 9299
  Gene Symbol: LRRC37A2
  Gene Name: leucine rich repeat containing 37, member A2
  ENST ID: ENST00000611862
  CDS Start-End: 4-5106
agaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagaggctaccaatgagacagaatcttcccaagctcagcaggagaccccaattcagtttccagaggaggtggaaccttctgcaacccaacaggaggccccaattgagcctccagttcctcctatggagcatgaactttccatcagtgagcagcagcagccagttcagccttctgagacttctagggaggtcgaatcttctccgacccagcaggagaccccaggtcagcctccagaacatcatgaagtcacagtttcacctccaggtgaccatcaaactcatcatttagattcacccagtgtctctgtgaagcctccagacgtgcagctcaccatagcagcagagcctagtgcagaggtgggaacttctctagtccagcaggaggctacaactcggctctcagggtcaggtaatgatatagaacctcccgccatccagcacgggggcccacctctgctttcagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccatgacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacccactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccgtctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccgagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccacggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaatgaa

SEQ ID NO: 148048 - DNA, 3853 bp, Homo sapiens
  Payload ID: 9299
  Gene Symbol: LRRC37A2
  Gene Name: leucine rich repeat containing 37, member A2
  ENST ID: ENST00000629060
  CDS Start-End: 1568-3784
gaaaactataatgcctttcaaatatggcttattgcttggatctcaatatctcccacgtatcttgggtggaatattttgctgaagatctttctgtcaatcatttacaatcatgtgctgcaaaatgaagtttgggtcaacagtagaccacatatatgatggtggttccgtaagcgtataatggagctatccctatataggtataccatttttatctttttttttttttttttttgagatggagtctcactctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatgttagcacaatggtgaaatcacctagtgacccatttctcaagctcctcacgtgggaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagggattctcctgctttggcctcctgagtagctgggattgcagaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccactttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctgggacccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccacggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaata

SEQ ID NO: 148049 - DNA, 4997 bp, Homo sapiens
  Payload ID: 9299
  Gene Symbol: LRRC37A2
  Gene Name: leucine rich repeat containing 37, member A2
  ENST ID: ENST00000629709
  CDS Start-End: 36-4943
cttacaaggggcacgagcgtctcggagctgccagaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccactttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctgggacccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaagggacagcgaagccccaacggaggaggaggagagtgaagccctgccataggaggagaacacagcccacctcaggcctcctgcaaaaatacatagaataaacaac

SEQ ID NO: 148050 - DNA, 5105 bp, Homo sapiens
  Payload ID: 9299
  Gene Symbol: LRRC37A2
  Gene Name: leucine rich repeat containing 37, member A2
  ENST ID: ENST00000633100
  CDS Start-End: 4-5034
agaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagaggctaccaatgagacagaatcttcccaagctcagcaggagaccccaattcagtttccagaggaggtggaaccttctgcaacccaacaggaggccccaattgagcctccagttcctcctatggagcatgaactttccatcagtgagcagcagcagccagttcagccttctgagacttctagggaggtcgaatcttctccgacccagcaggagaccccaggtcagcctccagaacatcatgaagtcacagtttcacctccaggtgaccatcaaactcatcatttagattcacccagtgtctctgtgaagcctccagacgtgcagctcaccatagcagcagagcctagtgcagaggtgggaacttctctagtccagcaggaggctacaactcggctctcagggtcaggtaatgatatagaacctcccgccatccagcacgggggcccacctctgctttcagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccatgacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacccactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccgtctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccgagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccacggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaatgaa

SEQ ID NO: 148051 - DNA, 3783 bp, Homo sapiens
  Payload ID: 9299
  Gene Symbol: LRRC37A2
  Gene Name: leucine rich repeat containing 37, member A2
  ENST ID: ENST00000631492
  CDS Start-End: 1498-3714
gaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttgagatggagtctcactctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaataacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataataatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcagaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccgagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccacggaggggatgctcttcgcgaagggagagtcaggatggactttcctcatttggacagccgctctggtttaaagatatgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaatg

SEQ ID NO: 148052 - DNA, 4925 bp, Homo sapiens
  Payload ID: 9299
  Gene Symbol: LRRC37A2
  Gene Name: leucine rich repeat containing 37, member A2
  ENST ID: ENST00000632864
  CDS Start-End: 36-4871
cttacaaggggcacgagcgtctcggagctgccagaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagaggctaccaatgagacagaatcttcccaagctcagcaggagaccccaattcagtttccagaggaggtggaaccttctgcaacccaacaggaggccccaattgagcctccagttcctcctatggagcatgaactttccatcagtgagcagcagcagccagttcagccttctgagacttctagggaggtcgaatcttctccgacccagcaggagaccccaggtcagcctccagaacatcatgaagtcacagtttcacctccaggtgaccatcaaactcatcatttagattcacccagtgtctctgtgaagcctccagacgtgcagctcaccatagcagcagagcctagtgcagaggtgggaacttctctagtccagcaggaggctacaactcggctctcagggtcaggtaatgatatagaacctcccgccatccagcacgggggcccacctctgctttcagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccatgacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacccactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccgtctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccgagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaagggacagcgaagccccaacggaggaggaggagagtgaagccctgccataggaggagaacacagcccacctcaggcctcctgcaaaaatacatagaataaacaac

SEQ ID NO: 148053 - DNA, 5537 bp, Homo sapiens
  Payload ID: 9300
  Gene Symbol: LRRC37A3
  Gene Name: leucine rich repeat containing 37, member A3
  Uniprot ID: O60309
  ENST ID: ENST00000319651
  CDS Start-End: 404-5308
ttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccatcccaccctaccccaccctaccccaccacagcaggcgctggagtcctgggaccaccaggatctgaggcccaaatccttcctcactaaggggaggagaggggtgctccggcagggcaggatgggaaggcgtgcttgggcgggattgtgacataagagtgccctggtgacatggagcagatctgtggcataaataaaggtgtcataaagacagggcgggactcatgcttacaaggggcacgagcgtctcggagctgccagaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacaccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtcttctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccatgacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacccactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcttccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccatatctctttaaattgccagcattaaaatatctagacatgggaacaacgctagtcccacttacaacacttaagaacattctcatgatgactgttgaactggaaaaactgatcgtacctagccatatggcctgctgcctctgccaatttaaaaacagcattgaggctgtctgcaagacagtcaagctgcattgcaacagtgcatgtctgacaaacaccacacattgtcctgaagaagcatctgtagggaatccagaaggagcgttcatgaaggtgttacaagcccggaagaattacacaagcactgagctgattattgagccggaggagccctcagacagcagtggcatcaacttgtcaggctttgggagtgagcagctagacaccaatgacgagagtgatgttaccagtacactaagttacatcttaccttatttctcagccgttaacctagatgtgaaatcactgttactaccgttcattaaactgccaaccacaggaaacagcctggcaaagattcaaactgtaggcaaaaaccggcagagactgaatagagtcctcatgggcccaaggagcatccagaaaaggcacttcaaagaggtaggaaggcagagcatcaggagggaacagggtgcccaggcatctgtggagaacactgccgaagaaaaaaggctcggaagtccagccccaagggagctgaaacagcctcacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatatgaagacatctaaacccatcgtacattccagaaaaaaataccgctttcacaaaactcgctcccgcatgacccacagaacacccaaggtcaaaaagagtccaaaggtcagaaagaaaagttatctgagtagactgatgctctcaaacaggcttccgttctctgcagcgaagagcctcataaattccccttcacaaggggctttttcatccttaagagacctgagtcctcaagaaaatccttttctggaagtatctgctccttcagaacattttatagaaaacaataatacaaaagacacaactgcaagaaatgcctttgaagaaaatgtttttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctgcagtccgttatccccaacaacaatgtgagaaggctcattgctcatgttatccggaccttgaagatggactgctctggggcccatgtgcaagtgacctgtgccaagctcgtctccaggacaggccacctgatgaagcttctcagtgggcagcaggaagtaaaggcatccaagatagaatgggatacggaccaatggaagactgagaactacattaatgagagcacagaagcccagagtgaacagaaagagaagtcgcttgagttcacaaaagaacttccaggatatggctataccaaaaaactcatcttggcgttaattgtgactggaatactaacgattttgattatacttctctgcctcattgagatctgttgtcaccgaaggtcattacaagaagatgaagaaggattctcaagggacagcgaagccccaacggaggaggagagtgaagccctgccataggaggagaacccagcccacctcaggcctcctgcaaaaatacatagcgtaaacaacggccatcaaaaaagcaggactgaagccagcggcccacacatccacagaggcagcgggcagagcaagcacagggccatcgttcctgcccttgtttcccagtctaattagtcacccagacctgaaaacatatgctcagggggtggagattttacaattaaataacattgtttttggt

SEQ ID NO: 148054 - DNA, 2654 bp, Homo sapiens
  Payload ID: 9300
  Gene Symbol: LRRC37A3
  Gene Name: leucine rich repeat containing 37, member A3
  ENST ID: ENST00000334962
  CDS Start-End: 584-2419
tttttcaatatcactcttcgtggattcttctttatattaaatatgttgtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccggaagttgggggcttattcagacttcttaaaagtctaccttcttcctctgtactttcagcccaaagtgagacttttgagttgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccacaggcttcaatgatacctttttcccacccctgtggtagtgttggctgcctcctttacctactcaagtaaccgctttaccgctaatttattgctctctgttttcatctataggatcgtacctagccatatggcctgctgcctctgccaatttaaaaacagcattgaggctgtctgcaagacagtcaagctgcattgcaacagtgcatgtctgacaaacaccacacattgtcctgaagaagcatctgtagggaatccagaaggagcgttcatgaaggtgttacaagcccggaagaattacacaagcactgagctgattattgagccggaggagccctcagacagcagtggcatcaacttgtcaggctttgggagtgagcagctagacaccaatgacgagagtgatgttaccagtacactaagttacatcttaccttatttctcagccgttaacctagatgtgaaatcactgttactaccgttcattaaactgccaaccacaggaaacagcctggcaaagattcaaactgtaggcaaaaaccggcagagactgaatagagtcctcatgggcccaaggagcatccagaaaaggcacttcaaagaggtaggaaggcagagcatcaggagggaacagggtgcccaggcatctgtggagaacactgccgaagaaaaaaggctcggaagtccagccccaagggagctgaaacagcctcacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatatgaagacatctaaacccatcgtacattccagaaaaaaataccgctttcacaaaactcgctcccgcatgacccacagaacacccaaggtcaaaaagagtccaaaggtcagaaagaaaagttatctgagtagactgatgctctcaaacaggcttccgttctctgcagcgaagagcctcataaattccccttcacaaggggctttttcatccttaagagacctgagtcctcaagaaaatccttttctggaagtatctgctccttcagaacattttatagaaaacaataatacaaaagacacaactgcaagaaatgcctttgaagaaaatgtttttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctgcagtccgttatccccaacaacaatgtgagaaggctcattgctcatgttatccggaccttgaagatggactgctctggggcccatgtgcaagtgacctgtgccaagctcgtctccaggacaggccacctgatgaagcttctcagtgggcagcaggaagtaaaggcatccaagatagaatgggatacggaccaatggaagactgagaactacattaatgagagcacagaagcccagagtgaacagaaagagaagtcgcttgagttcacaaaagaacttccaggatatggctataccaaaaaactcatcttggcgttaattgtgactggaatactaacgattttgattatacttctctgcctcattgagatctgttgtcaccgaaggtcattacaagaagatgaagaaggattctcaagggacagcgaagccccaacggaggaggagagtgaagccctgccataggaggagaacccagcccacctcaggcctcctgcaaaaatacatagcgtaaacaacggccatcaaaaaagcaggactgaagccagcggcccacacatccacagaggcagcgggcagagcaagcacagggccatcgttcctgcccttgtttcccagtctaattagtcacccagacctgaaaacatatgctcagggggtggagattttacaattaaataacattgtttttggtgccctc

SEQ ID NO: 148055 - DNA, 2589 bp, Homo sapiens
  Payload ID: 9300
  Gene Symbol: LRRC37A3
  Gene Name: leucine rich repeat containing 37, member A3
  ENST ID: ENST00000339474
  CDS Start-End: 44-2302
aacggaagaaacaagatggcggctgaaggcgatccgcatagagatggagtttcaccgtgttgcccaggctggtgtcgaactcctgagctcaggcgatccgcccgcctcagcttcccaaagtgttgggattataggcgtgagccactgcacctggcacagaaatttccaaggaaactatatttcttacattgatggaaatgtatggaaagcatacagttggaccgagaaactaattctcagagaaaataacttgactgaattacacaaggattcatttgaaggcctgctatccctccagtatttaattctcaatcacaatcctctgacaactgttgaagatccatatctctttaaattgccagcattaaaatatctagacatgggaacaacgctagtcccacttacaacacttaagaacattctcatgatgactgttgaactggaaaaactgatcgtacctagccatatggcctgctgcctctgccaatttaaaaacagcattgaggctgtctgcaagacagtcaagctgcattgcaacagtgcatgtctgacaaacaccacacattgtcctgaagaagcatctgtagggaatccagaaggagcgttcatgaaggtgttacaagcccggaagaattacacaagcactgagctgattattgagccggaggagccctcagacagcagtggcatcaacttgtcaggctttgggagtgagcagctagacaccaatgacgagagtgatgttaccagtacactaagttacatcttaccttatttctcagccgttaacctagatgtgaaatcactgttactaccgttcattaaactgccaaccacaggaaacagcctggcaaagattcaaactgtaggcaaaaaccggcagagactgaatagagtcctcatgggcccaaggagcatccagaaaaggcacttcaaagaggtaggaaggcagagcatcaggagggaacagggtgcccaggcatctgtggagaacactgccgaagaaaaaaggctcggaagtccagccccaagggagctgaaacagcctcacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatatgaagacatctaaacccatcgtacattccagaaaaaaataccgctttcacaaaactcgctcccgcatgacccacagaacacccaaggtcaaaaagagtccaaaggtcagaaagaaaagttatctgagtagactgatgctctcaaacaggcttccgttctctgcagcgaagagcctcataaattccccttcacaaggggctttttcatccttaagagacctgagtcctcaagaaaatccttttctggaagtatctgctccttcagaacattttatagaaaacaataatacaaaagacacaactgcaagaaatgcctttgaagaaaatgtttttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctgcagtccgttatccccaacaacaatgtgagaaggctcattgctcatgttatccggaccttgaagatggactgctctggggcccatgtgcaagtgacctgtgccaagctcgtctccaggacaggccacctgatgaagcttctcagtgggcagcaggaagtaaaggcatccaagatagaatgggatacggaccaatggaagactgagaactacattaatgagagcacagaagcccagagtgaacagaaagagaagtcgcttgagttcacaaaagaacttccaggatatggctataccaaaaaactcatcttggcgttaattgtgactggaatactaacgattttgattatacttctctgcctcattgagatctgttgtcaccgaaggtcattacaagaagatgaagaaggattctcaagggacagcgaagccccaacggaggaggagagtgaagccctgccataggaggagaacccagcccacctcaggcctcctgcaaaaatacatagcgtaaacaacggccatcaaaaaagcaggactgaagccagcggcccacacatccacagaggcagcgggcagagcaagcacagggccatcgttcctgcccttgtttcccagtctaattagtcacccagacctgaaaacatatgctcagggggtggagattttacaattaaataacattgtttttggtgccctctcccttggttcatcaagcaccagtcatataataccacatacttgaactcctg

SEQ ID NO: 148056 - DNA, 3273 bp, Homo sapiens
  Payload ID: 9300
  Gene Symbol: LRRC37A3
  Gene Name: leucine rich repeat containing 37, member A3
  ENST ID: ENST00000400877
  CDS Start-End: 1018-3036
attttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaataacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataataatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcagaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccatatctctttaaattgccagcattaaaatatctagacatgggaacaacgctagtcccacttacaacacttaagaacattctcatgatgactgttgaactggaaaaactgatcgtacctagccatatggcctgctgcctctgccaatttaaaaacagcattgaggctgtctgcaagacagtcaagctgcattgcaacagtgcatgtctgacaaacaccacacattgtcctgaagaagcatctgtagggaatccagaaggagcgttcatgaaggtgttacaagcccggaagaattacacaagcactgagctgattattgagccggaggagccctcagacagcagtggcatcaacttgtcaggctttgggagtgagcagctagacaccaatgacgagagtgatgttaccagtacactaagttacatcttaccttatttctcagccgttaacctagatgtgaaatcactgttactaccgttcattaaactgccaaccacaggaaacagcctggcaaagattcaaactgtaggcaaaaaccggcagagactgaatagagtcctcatgggcccaaggagcatccagaaaaggcacttcaaagaggtaggaaggcagagcatcaggagggaacagggtgcccaggcatctgtggagaacactgccgaagaaaaaaggctcggaagtccagccccaagggagctgaaacagcctcacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatatgaagacatctaaacccatcgtacattccagaaaaaaataccgctttcacaaaactcgctcccgcatgacccacagaacacccaaggtcaaaaagagtccaaaggtcagaaagaaaagttatctgagtagactgatgctctcaaacaggcttccgttctctgcagcgaagagcctcataaattccccttcacaaggggctttttcatccttaagagacctgagtcctcaagaaaatccttttctggaagtatctgctccttcagaacattttatagaaaacaataatacaaaagacacaactgcaagaaatgcctttgaagaaaatgtttttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctgcagtccgttatccccaacaacaatgtgagaaggctcattgctcatgttatccggaccttgaagatggactgctctggggcccatgtgcaagtgacctgtgccaagctcgtctccaggacaggccacctgatgaagcttctcagtgggcagcaggaagtaaaggcatccaagatagaatgggatacggaccaatggaagactgagaactacattaatgagagcacagaagcccagagtgaacagaaagagaagtcgcttgagttcacaaaagaacttccaggatatggctataccaaaaaactcatcttggcgttaattgtgactggaatactaacgattttgattatacttctctgcctcattgagatctgttgtcaccgaaggtcattacaagaagatgaagaaggattctcaagggacagcgaagccccaacggaggaggagagtgaagccctgccataggaggagaacccagcccacctcaggcctcctgcaaaaatacatagcgtaaacaacggccatcaaaaaagcaggactgaagccagcggcccacacatccacagaggcagcgggcagagcaagcacagggccatcgttcctgcccttgtttcccagtctaattagtcacccagacctgaaaacatatgctcagggggtggagattttacaattaaataacattgtttttggtgccctctc

SEQ ID NO: 148057 - DNA, 692 bp, Homo sapiens
  Payload ID: 9300
  Gene Symbol: LRRC37A3
  Gene Name: leucine rich repeat containing 37, member A3
  ENST ID: ENST00000584788
  CDS Start-End: 1-692
agccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttgatcgtacctagccatatggcctgctgcctctgccaatttaaaaacagcattgaggctgtctgcaagacagtcaagctgcattgca

SEQ ID NO: 148058 - DNA, 510 bp, Homo sapiens
  Payload ID: 9300
  Gene Symbol: LRRC37A3
  Gene Name: leucine rich repeat containing 37, member A3
  ENST ID: ENST00000583510
  CDS Start-End: 1-282
ggggcccatgtgcaagtgacctgtgccaagctcgtctccaggacaggccacctgatgaagcttctcagtgggcagcaggaagtaaaggcatccaagatagaatgggatacggaccaatggaagactgagaactacattaatgagagcacagaagcccagagtgaacagaaagagaagtcgcttgagatctgttgtcaccgaaggtcattacaagaagatgaagaaggattctcaagggacagcgaagccccaacggaggaggagagtgaagccctgccataggaggagaacccagcccacctcaggcctcctgcaaaaatacatagcgtaaacaacggccatcaaaaaagcaggactgaagccagcggcccacacatccacagaggcagcgggcagagcaagcacagggccatcgttcctgcccttgtttcccagtctaattagtcacccagacctgaaaacatatgctcagggggtggagattttacaattaaataacattgtttttgg

SEQ ID NO: 148059 - DNA, 589 bp, Homo sapiens
  Payload ID: 9300
  Gene Symbol: LRRC37A3
  Gene Name: leucine rich repeat containing 37, member A3
  ENST ID: ENST00000580464
  CDS Start-End: 1-589
ggttaaaccatctccaaccacggaggagacctcaactcagcttccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcaatcacaatcctctgacaactgttgaagatccatatctctttaaattgccagcattaaaatatctagacatgggaacaacgctagtcccacttacaacactt

SEQ ID NO: 148060 - DNA, 735 bp, Homo sapiens
  Payload ID: 9300
  Gene Symbol: LRRC37A3
  Gene Name: leucine rich repeat containing 37, member A3
  ENST ID: ENST00000581368
  CDS Start-End: 28-735
ccgcgctccggtaacggaagaaacaagatggcggctgaaggcgatccgcaaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccatatctctttaaattgccagcattaaaatatctagacatgggaacaacgctagtcccacttacaacacttaagaacattctcatgatgactgttgaactggaaaaactgatcgtacctagccatatggcctgctgcctctgccaatttaaaaacagcattgaggctgtctgcaagacagtcaagctgcattgcaacagtgcatgtctgacaaacaccacacattgtcctgaagaagcatctgtagggaatccagaaggagcgttcatgaaggtgttacaagcccggaagaattacacaagcactgagctgattattgagccggaggagccctcagacagcagtggcatc

SEQ ID NO: 148061 - DNA, 5665 bp, Homo sapiens
  Payload ID: 9300
  Gene Symbol: LRRC37A3
  Gene Name: leucine rich repeat containing 37, member A3
  Uniprot ID: O60309
  ENST ID: ENST00000584306
  CDS Start-End: 532-5436
tgggattataggcgtgagccactgcacctggcacaggctgaagtgcaatgttgtgatctcggctcactgcaacctctgcctcccaggttcaagcgattctcctgctttggcctcctgagtagctgggattgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccatcccaccctaccccaccctaccccaccacagcaggcgctggagtcctgggaccaccaggatctgaggcccaaatccttcctcactaaggggaggagaggggtgctccggcagggcaggatgggaaggcgtgcttgggcgggattgtgacataagagtgccctggtgacatggagcagatctgtggcataaataaaggtgtcataaagacagggcgggactcatgcttacaaggggcacgagcgtctcggagctgccagaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacaccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtcttctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccatgacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacccactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcttccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccatatctctttaaattgccagcattaaaatatctagacatgggaacaacgctagtcccacttacaacacttaagaacattctcatgatgactgttgaactggaaaaactgatcgtacctagccatatggcctgctgcctctgccaatttaaaaacagcattgaggctgtctgcaagacagtcaagctgcattgcaacagtgcatgtctgacaaacaccacacattgtcctgaagaagcatctgtagggaatccagaaggagcgttcatgaaggtgttacaagcccggaagaattacacaagcactgagctgattattgagccggaggagccctcagacagcagtggcatcaacttgtcaggctttgggagtgagcagctagacaccaatgacgagagtgatgttaccagtacactaagttacatcttaccttatttctcagccgttaacctagatgtgaaatcactgttactaccgttcattaaactgccaaccacaggaaacagcctggcaaagattcaaactgtaggcaaaaaccggcagagactgaatagagtcctcatgggcccaaggagcatccagaaaaggcacttcaaagaggtaggaaggcagagcatcaggagggaacagggtgcccaggcatctgtggagaacactgccgaagaaaaaaggctcggaagtccagccccaagggagctgaaacagcctcacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatatgaagacatctaaacccatcgtacattccagaaaaaaataccgctttcacaaaactcgctcccgcatgacccacagaacacccaaggtcaaaaagagtccaaaggtcagaaagaaaagttatctgagtagactgatgctctcaaacaggcttccgttctctgcagcgaagagcctcataaattccccttcacaaggggctttttcatccttaagagacctgagtcctcaagaaaatccttttctggaagtatctgctccttcagaacattttatagaaaacaataatacaaaagacacaactgcaagaaatgcctttgaagaaaatgtttttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctgcagtccgttatccccaacaacaatgtgagaaggctcattgctcatgttatccggaccttgaagatggactgctctggggcccatgtgcaagtgacctgtgccaagctcgtctccaggacaggccacctgatgaagcttctcagtgggcagcaggaagtaaaggcatccaagatagaatgggatacggaccaatggaagactgagaactacattaatgagagcacagaagcccagagtgaacagaaagagaagtcgcttgagttcacaaaagaacttccaggatatggctataccaaaaaactcatcttggcgttaattgtgactggaatactaacgattttgattatacttctctgcctcattgagatctgttgtcaccgaaggtcattacaagaagatgaagaaggattctcaagggacagcgaagccccaacggaggaggagagtgaagccctgccataggaggagaacccagcccacctcaggcctcctgcaaaaatacatagcgtaaacaacggccatcaaaaaagcaggactgaagccagcggcccacacatccacagaggcagcgggcagagcaagcacagggccatcgttcctgcccttgtttcccagtctaattagtcacccagacctgaaaacatatgctcagggggtggagattttacaattaaataacattgtttttggt

SEQ ID NO: 148062 - DNA, 5177 bp, Homo sapiens
  Payload ID: 9301
  Gene Symbol: LRRC37A
  Gene Name: leucine rich repeat containing 37A
  Uniprot ID: A6NMS7
  ENST ID: ENST00000320254
  CDS Start-End: 4-5106
agaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggactgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcacgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccatggaggggatgctcttcgcgaagggagagtcaggatggactttcctcatttggacagccgctctggtttaaagatctgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaatgaa

SEQ ID NO: 148063 - DNA, 4997 bp, Homo sapiens
  Payload ID: 9301
  Gene Symbol: LRRC37A
  Gene Name: leucine rich repeat containing 37A
  ENST ID: ENST00000393465
  CDS Start-End: 36-4943
cttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggactgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcacgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaagggacagcgaagccccaacggaggaggaggagagtgaagccctgccataggaggagaacacagcccacctcaggcctcctgcaaaaatacatagaataaacaac

SEQ ID NO: 148064 - DNA, 3860 bp, Homo sapiens
  Payload ID: 9301
  Gene Symbol: LRRC37A
  Gene Name: leucine rich repeat containing 37A
  ENST ID: ENST00000496930
  CDS Start-End: 1575-3791
gaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcagaaatttccaaggaaactatatttcttacattgatggaaatgtatggaaagcatacagttggactgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcacgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccatggaggggatgctcttcgcgaagggagagtcaggatggactttcctcatttggacagccgctctggtttaaagatctgtacaaacctctcagtgccacaagaataaataatcatgcatggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaatg

SEQ ID NO: 148065 - DNA, 5183 bp, Homo sapiens
  Payload ID: 9301
  Gene Symbol: LRRC37A
  Gene Name: leucine rich repeat containing 37A
  ENST ID: ENST00000611823
  CDS Start-End: 4-5106
agaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaagacacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccactttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccacggaggggatgctcttcgcgaagggagagtcaggatggactttcctcatttggacagccgctctggtttaaagatatgtacaaacctctcagtgccacaagaataaataatcatgcgtggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaataaatgaaaa

SEQ ID NO: 148066 - DNA, 3854 bp, Homo sapiens
  Payload ID: 9301
  Gene Symbol: LRRC37A
  Gene Name: leucine rich repeat containing 37A
  ENST ID: ENST00000629032
  CDS Start-End: 1570-3786
ttgaaaactataatgcctttcaaatatggcttattgcttggatctcaatatctcccacgtatcttgggtggaatattttgctgaagatctttctgtcaatcatttacaatcatgtgctgcaaaatgaagtttgggtcaacagtagaccacatatatgatggtggttccgtaagcgtataatggagctatccctatataggtataccatttttatctttttttttttttttttttgagatggagtctcactctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatgttagcacaatggtgaaatcacctagtgacccatttctcaagctcctcacgtgggaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagggattctcctgctttggcctcctgagtagctgggattgcagaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaagacacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccactttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaaggggcattttcagatttctgccacggaggggatgctcttcgcgaagggagagtcaggatggactttcctcatttggacagccgctctggtttaaagatatgtacaaacctctcagtgccacaagaataaataatcatgcgtggaagctgcacaagaagtcatctaatgaggacaagatcctcaacagggaccctggggacagcgaagccccaacggaggaggaggagagtgaagccctgccataggaggagaacacagcccacctcaggcctcctgcaaaaatacatagaataaacaacaacagttactaaat

SEQ ID NO: 148067 - DNA, 5010 bp, Homo sapiens
  Payload ID: 9301
  Gene Symbol: LRRC37A
  Gene Name: leucine rich repeat containing 37A
  ENST ID: ENST00000625784
  CDS Start-End: 36-4943
cttacaaggggcacgagcgtctcggagctgccagaatgacttccgctcagtgcccggcactagcgtgtgtcatgtccccgctgcgtttctggggcccatggcccctccttatgtggcaactattgtggctactagtcaaggaggctcagcctctggagtgggtcaaggacccgctccagctgacctctaaccccctggggccgcctgagccctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagctgcccctggagccagagcagttcttggcttcacagcaggatttaaaggacaagctgagtccacaggaaaggctccctgtttcgcccaagaagctgaagaaagatccagctcagcgttggagccttgctgagattattggaattatacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttaaatttccaaggaaactatatttcttacattgatggaaatgtatggaaagcatacagttggaccgagaaactaattctcagagaaaataacttgactgaattacacaaggattcatttgaaggcctgctatccctccagtatttagatttatcctgcaataaaatacagtctattgaaagacatacatttgaaccactaccatttttgaagtttataaatcttagttgcaatgtaattacagaactcagctttggaacatttcaggcctggcacggaatgcagtttttacataagttaattctcaatcacaatcctctgacaactgttgaagatccgtatctctttaaattgccagcattaaaatatctagacatgggaacaacgctagtcccacttacaacacttaagaacattctcatgatgactgttgaactggaaaaactgatcttacctagccatatggcctgctgcctctgccaatttaaaaacagcattgaggctgtctgcaagacagtcaagctgcattgcaacagtgcatgtctgacaaacaccacacattgtcctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactacgttacatcttgccttatttctcagcggtaaacctagatgtgaaatcactgttactaccgttaattaaactgccaaccacaggaaacagcctggcaaagattcaaactgtaggccaaaaccggcagagagtgaagagagtcctcatgggcccaaggagcatccagaaaagacacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccactttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgagctcaaaaaagaagttccaggatatggctatactgacaaactcatcttggcattaattgttactggaatactaacgattttgattatacttttctgcctcattgtgatatgttgtcaccgaaggtcattacaagaagatgaagaaggattctcaagggacagcgaagccccaacggaggaggaggagagtgaagccctgccataggaggagaacacagcccacctcaggcctcctgcaaaaatacatagaataaacaacaacagttactaaa

SEQ ID NO: 148068 - DNA, 3162 bp, Homo sapiens
  Payload ID: 9302
  Gene Symbol: LRRC37B
  Gene Name: leucine rich repeat containing 37B
  ENST ID: ENST00000327564
  CDS Start-End: 62-2986
aacagatctggacccaagcctaataaaggtgacataaataaaggtgtcataaagacagggcatggcacacgcttataaggggcatgagcatctcagggctgccagaatggcttttgctgagtgcatagcaccagcgtgtgtcatgtcttggctgcgtttctggggcccatggcccctccttacgtggcaactattgtctttactagtcaaggaggctcagcctctggtgtgggtcaaggacccgctccagctgacctctaaccccctggggccacctgagccctggtcttcccgctcctcccatctcccatgggaatctccccatgcacctgctcccccagcagccccgggggactttgattacctggggccctctgcttcttcgcagatgtcagccctgcctcaggaaccaactgaaaatttggctccattcctgaaggaattggattcagctggagagctgcccctggggccagagccgttcttggctgcacatcaggacttaaatgacaagcggactccagaagaaaggctcccagaggtggttccgcttctcaaccgggatcagaaccaggccctagttcagcttcctcgcctcaagtgggttcaaactacagatctagatcgggctgcaggtcatcaggcagatgaaatacttgttccactagacagtaaggtttcaagaccaaccaaatttgttgtttcgcccaagaacctgaagaaagatctagctgaacgttggagccttcctgagattgttgggattccacaccaattatccaaacctcagcgtcagaaacagactttgccagatgattatttgagtatggacacactgtatcccggcagcctacctccagaactccgggtgaacgcagatgagcctccagggcctcctgagcaagttggactttctcaattccatctagagcccaaaagtcaaaatccagagacccttgaagacatccagtcctcttcactccaggaagaagccccagcgcagcttctacagctccctcaggaggtagaaccttcaacccagcaggaggccccagctctgcctccagagtcctctatggagagtctagctcaaactccactgaatcatgaagtgacagttcaacctccaggtgaggatcaagctcattataatttgcccaagtttacagtcaaacctgcagatgtggaggttaccatgacttcagagcctaaaaatgagacagaatctacccaagcccagcaggaggccccaattcagcctcccgaggaggcggaaccttcttctacagccctgaggactacagatcctcctccagaacaccctgaggtgacacttccaccttcagacaagggtcaggctcagcattcacacctgactgaagccacagttcaacctctggacctggagcttagcataactacagagcctactacagaggttaaaccgtctccaaccacggaggaaacctcagctcagcctccagacccggggcttgccataactccagaacccactacagagattggacattccacagccctggagaagactagagctcctcatccagaccaggttcagactctgcatcgaagcctgactgaagtcacaggtccacctacaaagttagaatcttcgcaggattcattggtgcagtctgaaactgcaccagaggaacagaaggcctccacaagcaccaacatatgtgagctctgcacctgcggagatgagactctgtcatgtgttggtctcagcccaaagcagaggctccgccaagtgcctgtgccagagcccgacacctacaatggcatcttcaccaccttaaatttccaaggaaactatatttcataccttgatggaaatgtatggaaagcatacagttggaccgagaaactaattctcagtgaaaattatttgactgaattacctaaggattcatttgaaggcctgctatacctccagtatttagatttatcctgcaataaaatacgatatattgaaagacaaacatttgaatcactaccatttttgcagtatataaatctgggctgcaatttaattacaaaactgagccttggaacatttcaggcctggcacggaatgcagtttttacacaacttaattctcaatcgcaatcctctgactactgtcgaagatccatatctctttgaactgccggcattaaaatatctagacatgggaacaacacacatcacacttacaacacttaagaacattctcacgatgactgttgaactggaaaaactgatcttacctagccatatggcctgctgcctctgccaatttaaaaatagcattgaggctgtctgcaagacagtcaagctgcattgcaacactgcatgtctgactaacagcatacattgtcctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaatgttcagaaacacatgtgcaagggagctgtgccaagctcatgttgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggagatgactataagaacaaactcatcttcgcaatatctgtgactgtaatactaataattttgattataattttttgtcttatagaggtgaattcacataaaagggcatcagaaaaatacaaagacaacccatcaatatcaggagcctgagcatgagttaaagcatgtggatggcctggagctatgtttttaaaattgttattaaatattggttttttacttaaatcaatgaaaactttctttactttgtggttgtgttcctcaaaatgagaatttttaacaataataaaaataaagcttgttagatcatttttaatggtaataaa

SEQ ID NO: 148069 - DNA, 3025 bp, Homo sapiens
  Payload ID: 9302
  Gene Symbol: LRRC37B
  Gene Name: leucine rich repeat containing 37B
  Uniprot ID: Q96QE4
  ENST ID: ENST00000341671
  CDS Start-End: 6-2849
gtgtcatgtcttggctgcgtttctggggcccatggcccctccttacgtggcaactattgtctttactagtcaaggaggctcagcctctggtgtgggtcaaggacccgctccagctgacctctaaccccctggggccacctgagccctggtcttcccgctcctcccatctcccatgggaatctccccatgcacctgctcccccagcagccccgggggactttgattacctggggccctctgcttcttcgcagatgtcagccctgcctcaggaaccaactgaaaatttggctccattcctgaaggaattggattcagctggagagctgcccctggggccagagccgttcttggctgcacatcaggacttaaatgacaagcggactccagaagaaaggctcccagaggtggttccgcttctcaaccgggatcagaaccaggccctagttcagcttcctcgcctcaagtgggttcaaactacagatctagatcgggctgcaggtcatcaggcagatgaaatacttgttccactagacagtaaggtttcaagaccaaccaaatttgttgtttcgcccaagaacctgaagaaagatctagctgaacgttggagccttcctgagattgttgggattccacaccaattatccaaacctcagcgtcagaaacagactttgccagatgattatttgagtatggacacactgtatcccggcagcctacctccagaactccgggtgaacgcagatgagcctccagggcctcctgagcaagttggactttctcaattccatctagagcccaaaagtcaaaatccagagacccttgaagacatccagtcctcttcactccaggaagaagccccagcgcagcttctacagctccctcaggaggtagaaccttcaacccagcaggaggccccagctctgcctccagagtcctctatggagagtctagctcaaactccactgaatcatgaagtgacagttcaacctccaggtgaggatcaagctcattataatttgcccaagtttacagtcaaacctgcagatgtggaggttaccatgacttcagagcctaaaaatgagacagaatctacccaagcccagcaggaggccccaattcagcctcccgaggaggcggaaccttcttctacagccctgaggactacagatcctcctccagaacaccctgaggtgacacttccaccttcagacaagggtcaggctcagcattcacacctgactgaagccacagttcaacctctggacctggagcttagcataactacagagcctactacagaggttaaaccgtctccaaccacggaggaaacctcagctcagcctccagacccggggcttgccataactccagaacccactacagagattggacattccacagccctggagaagactagagctcctcatccagaccaggttcagactctgcatcgaagcctgactgaagtcacaggtccacctacaaagttagaatcttcgcaggattcattggtgcagtctgaaactgcaccagaggaacagaaggcctccacaagcaccaacatatgtgagctctgcacctgcggagatgagactctgtcatgtgttggtctcagcccaaagcagaggctccgccaagtgcctgtgccagagcccgacacctacaatggcatcttcaccaccttaaatttccaaggaaactatatttcataccttgatggaaatgtatggaaagcatacagttggaccgagaaactaattctcagtgaaaattatttgactgaattacctaaggattcatttgaaggcctgctatacctccagtatttagatttatcctgcaataaaatacgatatattgaaagacaaacatttgaatcactaccatttttgcagtatataaatctgggctgcaatttaattacaaaactgagccttggaacatttcaggcctggcacggaatgcagtttttacacaacttaattctcaatcgcaatcctctgactactgtcgaagatccatatctctttgaactgccggcattaaaatatctagacatgggaacaacacacatcacacttacaacacttaagaacattctcacgatgactgttgaactggaaaaactgatcttacctagccatatggcctgctgcctctgccaatttaaaaatagcattgaggctgtctgcaagacagtcaagctgcattgcaacactgcatgtctgactaacagcatacattgtcctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaatgttcagaaacacatgtgcaagggagctgtgccaagctcatgttgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggagatgactataagaacaaactcatcttcgcaatatctgtgactgtaatactaataattttgattataattttttgtcttatagaggtgaattcacataaaagggcatcagaaaaatacaaagacaacccatcaatatcaggagcctgagcatgagttaaagcatgtggatggcctggagctatgtttttaaaattgttattaaatattggttttttacttaaatcaatgaaaactttctttactttgtggttgtgttcctcaaaatgagaatttttaacaataataaaaataaagcttgttagatcatttttaatggtaataaa

SEQ ID NO: 148070 - DNA, 3025 bp, Homo sapiens
  Payload ID: 9302
  Gene Symbol: LRRC37B
  Gene Name: leucine rich repeat containing 37B
  Uniprot ID: Q96QE4
  ENST ID: ENST00000394713
  CDS Start-End: 12-2855
cagcgtgtgtcatgtcttggctgcgtttctggggcccatggcccctccttacgtggcaactattgtctttactagtcaaggaggctcagcctctggtgtgggtcaaggacccgctccagctgacctctaaccccctggggccacctgagccctggtcttcccgctcctcccatctcccatgggaatctccccatgcacctgctcccccagcagccccgggggactttgattacctggggccctctgcttcttcgcagatgtcagccctgcctcaggaaccaactgaaaatttggctccattcctgaaggaattggattcagctggagagctgcccctggggccagagccgttcttggctgcacatcaggacttaaatgacaagcggactccagaagaaaggctcccagaggtggttccgcttctcaaccgggatcagaaccaggccctagttcagcttcctcgcctcaagtgggttcaaactacagatctagatcgggctgcaggtcatcaggcagatgaaatacttgttccactagacagtaaggtttcaagaccaaccaaatttgttgtttcgcccaagaacctgaagaaagatctagctgaacgttggagccttcctgagattgttgggattccacaccaattatccaaacctcagcgtcagaaacagactttgccagatgattatttgagtatggacacactgtatcccggcagcctacctccagaactccgggtgaacgcagatgagcctccagggcctcctgagcaagttggactttctcaattccatctagagcccaaaagtcaaaatccagagacccttgaagacatccagtcctcttcactccaggaagaagccccagcgcagcttctacagctccctcaggaggtagaaccttcaacccagcaggaggccccagctctgcctccagagtcctctatggagagtctagctcaaactccactgaatcatgaagtgacagttcaacctccaggtgaggatcaagctcattataatttgcccaagtttacagtcaaacctgcagatgtggaggttaccatgacttcagagcctaaaaatgagacagaatctacccaagcccagcaggaggccccaattcagcctcccgaggaggcggaaccttcttctacagccctgaggactacagatcctcctccagaacaccctgaggtgacacttccaccttcagacaagggtcaggctcagcattcacacctgactgaagccacagttcaacctctggacctggagcttagcataactacagagcctactacagaggttaaaccgtctccaaccacggaggaaacctcagctcagcctccagacccggggcttgccataactccagaacccactacagagattggacattccacagccctggagaagactagagctcctcatccagaccaggttcagactctgcatcgaagcctgactgaagtcacaggtccacctacaaagttagaatcttcgcaggattcattggtgcagtctgaaactgcaccagaggaacagaaggcctccacaagcaccaacatatgtgagctctgcacctgcggagatgagactctgtcatgtgttggtctcagcccaaagcagaggctccgccaagtgcctgtgccagagcccgacacctacaatggcatcttcaccaccttaaatttccaaggaaactatatttcataccttgatggaaatgtatggaaagcatacagttggaccgagaaactaattctcagtgaaaattatttgactgaattacctaaggattcatttgaaggcctgctatacctccagtatttagatttatcctgcaataaaatacgatatattgaaagacaaacatttgaatcactaccatttttgcagtatataaatctgggctgcaatttaattacaaaactgagccttggaacatttcaggcctggcacggaatgcagtttttacacaacttaattctcaatcgcaatcctctgactactgtcgaagatccatatctctttgaactgccggcattaaaatatctagacatgggaacaacacacatcacacttacaacacttaagaacattctcacgatgactgttgaactggaaaaactgatcttacctagccatatggcctgctgcctctgccaatttaaaaatagcattgaggctgtctgcaagacagtcaagctgcattgcaacactgcatgtctgactaacagcatacattgtcctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaatgttcagaaacacatgtgcaagggagctgtgccaagctcatgttgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggagatgactataagaacaaactcatcttcgcaatatctgtgactgtaatactaataattttgattataattttttgtcttatagaggtgaattcacataaaagggcatcagaaaaatacaaagacaacccatcaatatcaggagcctgagcatgagttaaagcatgtggatggcctggagctatgtttttaaaattgttattaaatattggttttttacttaaatcaatgaaaactttctttactttgtggttgtgttcctcaaaatgagaatttttaacaataataaaaataaagcttgttagatcatttttaatggt

SEQ ID NO: 148071 - DNA, 3091 bp, Homo sapiens
  Payload ID: 9302
  Gene Symbol: LRRC37B
  Gene Name: leucine rich repeat containing 37B
  ENST ID: ENST00000543378
  CDS Start-End: 336-2933
gatgccgaggagacccaggagtctgaggacaactaggaggatgacatggaggaggacgacgatgactccgattatccggaggagctggaagatgacgacgaggacgccagttactccacggaaagcagcttcagcagcactccagaaagtggtaaaatagctgtggagtgcagacccagtgaagagattgtagatgtcagatgggaagaactacacagtttaattcaagtcagttgctctcccctgaaggaagagtattctcggatttcacctcagaggaggaagaattcaggctgccagaactggactagcacttctgaagatcccaaggccagatgtcagccctgcctcaggaaccaactgaaaatttggctccattcctgaaggaattggattcagctggagagctgcccctggggccagagccgttcttggctgcacatcaggacttaaatgacaagcggactccagaagaaaggctcccagaggtggttccgcttctcaaccgggatcagaaccaggccctagttcagcttcctcgcctcaagtgggttcaaactacagatctagatcgggctgcaggtcatcaggcagatgaaatacttgttccactagacagtaaggtttcaagaccaaccaaatttgttgtttcgcccaagaacctgaagaaagatctagctgaacgttggagccttcctgagattgttgggattccacaccaattatccaaacctcagcgtcagaaacagactttgccagatgattatttgagtatggacacactgtatcccggcagcctacctccagaactccgggtgaacgcagatgagcctccagggcctcctgagcaagttggactttctcaattccatctagagcccaaaagtcaaaatccagagacccttgaagacatccagtcctcttcactccaggaagaagccccagcgcagcttctacagctccctcaggaggtagaaccttcaacccagcaggaggccccagctctgcctccagagtcctctatggagagtctagctcaaactccactgaatcatgaagtgacagttcaacctccaggtgaggatcaagctcattataatttgcccaagtttacagtcaaacctgcagatgtggaggttaccatgacttcagagcctaaaaatgagacagaatctacccaagcccagcaggaggccccaattcagcctcccgaggaggcggaaccttcttctacagccctgaggactacagatcctcctccagaacaccctgaggtgacacttccaccttcagacaagggtcaggctcagcattcacacctgactgaagccacagttcaacctctggacctggagcttagcataactacagagcctactacagaggttaaaccgtctccaaccacggaggaaacctcagctcagcctccagacccggggcttgccataactccagaacccactacagagattggacattccacagccctggagaagactagagctcctcatccagaccaggttcagactctgcatcgaagcctgactgaagtcacaggtccacctacaaagttagaatcttcgcaggattcattggtgcagtctgaaactgcaccagaggaacagaaggcctccacaagcaccaacatatgtgagctctgcacctgcggagatgagactctgtcatgtgttggtctcagcccaaagcagaggctccgccaagtgcctgtgccagagcccgacacctacaatggcatcttcaccaccttaaatttccaaggaaactatatttcataccttgatggaaatgtatggaaagcatacagttggaccgagaaactaattctcagtgaaaattatttgactgaattacctaaggattcatttgaaggcctgctatacctccagtatttagatttatcctgcaataaaatacgatatattgaaagacaaacatttgaatcactaccatttttgcagtatataaatctgggctgcaatttaattacaaaactgagccttggaacatttcaggcctggcacggaatgcagtttttacacaacttaattctcaatcgcaatcctctgactactgtcgaagatccatatctctttgaactgccggcattaaaatatctagacatgggaacaacacacatcacacttacaacacttaagaacattctcacgatgactgttgaactggaaaaactgatcttacctagccatatggcctgctgcctctgccaatttaaaaatagcattgaggctgtctgcaagacagtcaagctgcattgcaacactgcatgtctgactaacagcatacattgtcctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaatgttcagaaacacatgtgcaagggagctgtgccaagctcatgttgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggagatgactataagaacaaactcatcttcgcaatatctgtgactgtaatactaataattttgattataattttttgtcttatagaggtgaattcacataaaagggcatcagaaaaatacaaagacaacccatcaatatcaggagcctgagcatgagttaaagcatgtggatggcctggagctatgtttttaaaattgttattaaatattggttttttacttaaatcaatgaaaactttctttactttgtggttgtgttcctcaaaatgagaatttttaacaataataaaaataaagcttgttagatc

SEQ ID NO: 148072 - DNA, 2773 bp, Homo sapiens
  Payload ID: 9302
  Gene Symbol: LRRC37B
  Gene Name: leucine rich repeat containing 37B
  ENST ID: ENST00000584368
  CDS Start-End: 15-2741
tcagggctgccagaatggcttttgctgagtgcatagcaccagcgtgtgtcatgtcttggctgcgtttctggggcccatggcccctccttacgtggcaactattgtctttactagtcaaggaggctcagcctctggtgtgggtcaaggacccgctccagctgacctctaaccccctggggccacctgagccctggtcttcccgctcctcccatctcccatgggaatctccccatgcacctgctcccccagcagccccgggggactttgattacctggggccctctgcttcttcgcagatgtcagccctgcctcaggaaccaactgaaaatttggctccattcctgaaggaattggattcagctggagagctgcccctggggccagagccgttcttggctgcacatcaggacttaaatgacaagcggactccagaagaaaggctcccagaggtggttccgcttctcaaccgggatcagaaccaggccctagttcagcttcctcgcctcaagtgggttcaaactacagatctagatcgggctgcaggtcatcaggcagatgaaatacttgttccactagacagtaaggtttcaagaccaaccaaatttgttgtttcgcccaagaacctgaagaaagatctagctgaacgttggagccttcctgagattgttgggattccacaccaattatccaaacctcagcgtcagaaacagactttgccagatgattatttgagtatggacacactgtatcccggcagcctacctccagaactccgggtgaacgcagatgagcctccagggcctcctgagcaagttggactttctcaattccatctagagcccaaaagtcaaaatccagagacccttgaagacatccagtcctcttcactccaggaagaagccccagcgcagcttctacagctccctcaggaggtagaaccttcaacccagcaggaggccccagctctgcctccagagtcctctatggagagtctagctcaaactccactgaatcatgaagtgacagttcaacctccaggtgaggatcaagctcattataatttgcccaagtttacagtcaaacctgcagatgtggaggttaccatgacttcagagcctaaaaatgagacagaatctacccaagcccagcaggaggccccaattcagcctcccgaggaggcggaaccttcttctacagccctgaggactacagatcctcctccagaacaccctgaggtgacacttccaccttcagacaagggtcaggctcagcattcacacctgactgaagccacagttcaacctctggacctggagcttagcataactacagagcctactacagaggttaaaccgtctccaaccacggaggaaacctcagctcagcctccagacccggggcttgccataactccagaacccactacagagattggacattccacagccctggagaagactagagctcctcatccagaccaggttcagactctgcatcgaagcctgactgaagtcacaggtccacctacaaagttagaatcttcgcaggattcattggtgcagtctgaaactgcaccagaggaacagaaggcctccacaagcaccaacatatgtgagctctgcacctgcggagatgagactctgtcatgtgttggtctcagcccaaagcagaggctccgccaagtgcctgtgccagagcccgacacctacaatggcatcttcaccaccttaaatttccaaggaaactatatttcataccttgatggaaatgtatggaaagcatacagttggaccgagaaactaattctcagtgaaaattatttgactgaattacctaaggattcatttgaaggcctgctatacctccagtatttaattctcaatcgcaatcctctgactactgtcgaagatccatatctctttgaactgccggcattaaaatatctagacatgggaacaacacacatcacacttacaacacttaagaacattctcacgatgactgttgaactggaaaaactgatcttacctagccatatggcctgctgcctctgccaatttaaaaatagcattgaggctgtctgcaagacagtcaagctgcattgcaacactgcatgtctgactaacagcatacattgtcctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaatgttcagaaacacatgtgcaagggagctgtgccaagctcatgttgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggagatgactataagaacaaactcatcttcgcaatatctgtgactgtaatactaataattttgattataattttttgtcttatagaggtgaattcacataaaagggcatcagaaaaatacaaagacaacccatcaatatcaggagcctgagcatgagttaaagcatgtggatggcctggagc

SEQ ID NO: 148073 - DNA, 764 bp, Homo sapiens
  Payload ID: 9302
  Gene Symbol: LRRC37B
  Gene Name: leucine rich repeat containing 37B
  ENST ID: ENST00000582117
  CDS Start-End: 1-710
ctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaatgttcagaaacacatgtgcaagggagctgtgccaagctcatgttgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggagatgactataagaacaaactcatcttcgcaatatctgtgactgtaatactaataattttgattataattttttgtcttatagaggtaaggacaataattaattcaggttttcagaatacaatcctgtgtttgtgtggattcagaatccacaaactgaaaaccaacgtcactttcccacttgacattcttcttctgtcatttaaggctgaggtgtgctttgttcttttactgcaatgtatattccaggattgttaaaggatcctcgcttccaggaggtctctgtgaaataaaaccaagttaatcccacta

SEQ ID NO: 148074 - DNA, 733 bp, Homo sapiens
  Payload ID: 9302
  Gene Symbol: LRRC37B
  Gene Name: leucine rich repeat containing 37B
  ENST ID: ENST00000579206
  CDS Start-End: 267-733
aggaggggggcggcgatgccgaggagacccaggagtctgaggacaactaggaggatgacatggaggaggacgacgatgactccgattatccggaggagctggaagatgacgacgaggacgccagttactccacggaaagcagcttcagcagcactccaggtcagttgctctcccctgaaggaagagtattctcggatttcacctcagaggaggaagaattcaggctgccagaactggactagcacttctgaagatcccaaggccagatgtcagccctgcctcaggaaccaactgaaaatttggctccattcctgaaggaattggattcagctggagagctgcccctggggccagagccgttcttggctgcacatcaggacttaaatgacaagcggactccagaagaaaggctcccagaggtggttccgcttctcaaccgggatcagaaccaggccctagttcagcttcctcgcctcaagtgggttcaaactacagatctagatcgggctgcaggtcatcaggcagatgaaatacttgttccactagacagtaaggtttcaagaccaaccaaatttgttgtttcgcccaagaacctgaagaaagatctagctgaacgttggagccttcctgagattgttgggattccacaccaattatccaaacctcagcgtcagaaacagactttgccagatgattatttgagtatggacacactgtatcccggcagcctacc

SEQ ID NO: 148075 - DNA, 725 bp, Homo sapiens
  Payload ID: 9302
  Gene Symbol: LRRC37B
  Gene Name: leucine rich repeat containing 37B
  ENST ID: ENST00000583342
  CDS Start-End: 70-725
ggcgggggcgcgggggcagccacctagcccggaccaccgcagcccggagggctgtcaacagagtggtgtatgatgactacgagagcgaggaggaggagtaagaggaggggggcggcgatgccgaggagacccaggagtctgaggacaactaggaggatgacatggaggaggacgacgatgactccgattatccggaggagctggaagatgacgacgaggacgccagttactccacggaaagcagcttcagcagcactccagatgtcagccctgcctcaggaaccaactgaaaatttggctccattcctgaaggaattggattcagctggagagctgcccctggggccagagccgttcttggctgcacatcaggacttaaatgacaagcggactccagaagaaaggctcccagaggtggttccgcttctcaaccgggatcagaaccaggccctagttcagcttcctcgcctcaagtgggttcaaactacagatctagatcgggctgcaggtcatcaggcagatgaaatacttgttccactagacagtaaggtttcaagaccaaccaaatttgttgtttcgcccaagaacctgaagaaagatctagctgaacgttggagccttcctgagattgttgggattccacaccaattatccaaacctcagcgtcagaaacagactttgccagatgattatttgagtatggacacactgtatcccggcagcct

SEQ ID NO: 148076 - DNA, 2807 bp, Homo sapiens
  Payload ID: 9302
  Gene Symbol: LRRC37B
  Gene Name: leucine rich repeat containing 37B
  ENST ID: ENST00000578674
  CDS Start-End: 15-2177
tcagggctgccagaatggcttttgctgagtgcatagcaccagcgtgtgtcatgtcttggctgcgtttctggggcccatggcccctccttacgtggcaactattgtctttactagtcaaggaggctcagcctctggtgtgggtcaaggacccgctccagctgacctctaaccccctggggccacctgagccctggtcttcccgctcctcccatctcccatgggaatctccccatgcacctgctcccccagcagccccgggggactttgattacctggggccctctgcttcttcgcagatgtcagccctgcctcaggaaccaactgaaaatttggctccattcctgaaggaattggattcagctggagagctgcccctggggccagagccgttcttggctgcacatcaggacttaaatgacaagcggactccagaagaaaggctcccagaggtggttccgcttctcaaccgggatcagaaccaggccctagttcagcttcctcgcctcaagtgggttcaaactacagatctagatcgggctgcaggtcatcaggcagatgaaatacttgttccactagacagtaaggtttcaagaccaaccaaatttgttgtttcgcccaagaacctgaagaaagatctagctgaacgttggagccttcctgagattgttgggattccacaccaattatccaaacctcagcgtcagaaacagactttgccagatgattatttgagtatggacacactgtatcccggcagcctacctccagaactccgggtgaacgcagatgagcctccagggcctcctgagcaagttggactttctcaattccatctagagcccaaaagtcaaaatccagagacccttgaagacatccagtcctcttcactccaggaagaagccccagcgcagcttctacagctccctcaggaggtagaaccttcaacccagcaggaggccccagctctgcctccagagtcctctatggagagtctagctcaaactccactgaatcatgaagtgacagttcaacctccaggtgaggatcaagctcattataatttgcccaagtttacagtcaaacctgcagatgtggaggttaccatgacttcagagcctaaaaatgagacagaatctacccaagcccagcaggaggccccaattcagcctcccgaggaggcggaaccttcttctacagccctgaggactacagatcctcctccagaacaccctgaggtgacacttccaccttcagacaagggtcaggctcagcattcacacctgactgaagccacagttcaacctctggacctggagcttagcataactacagagcctactacagaggttaaaccgtctccaaccacggaggaaacctcagctcagcctccagacccggggcttgccataactccagaacccactacagagattggacattccacagccctggagaagactagagctcctcatccagaccaggttcagactctgcatcgaagcctgactgaagtcacaggtccacctacaaagttagaatcttcgcaggattcattggtgcagtctgaaactgcaccagaggaacagaaggcctccacaagcaccaacatatgtgagctctgcacctgcggagatgagactctgtcatgtgttggtctcagcccaaagcagaggctccgccaagtgcctgtgccagagcccgacacctacaatggcatcttcaccaccttaaatttccaaggaaactatatttcataccttgatggaaatgtatggaaagcatacagttggaccgagaaactaattctcagtgaaaattatttgactgaattacctaaggattcatttgaaggcctgctatacctccagtatttagatttatcctgcaataaaatacgatatattgaaagacaaacatttgaatcactaccatttttgcagtatataaatctgggctgcaatttaattacaaaactgagccttggaacatttcaggcctggcacggaatgcagtttttacacaacttaattctcaatcgcaatcctctgactactgtcgaagatccatatctctttgaactgccggcattaaaatatctagacatgggaacaacacacatcacacttacaacacttaagaacattctcacgatgactgttgaactggaaaaactctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgatcagcttgaaattcagctaaccgagcagctacggtccctcatccccaacgaggatgtgagaaagttcatgtctcatgttatccggaccttgaaaatggaatgttcagaaacacatgtgcaagggagctgtgccaagctcatgttgcgaacaggcctcctgatgaagcttctcagcgagcagcaggaagcaaaggcattgaatgtagaatgggatacggaccaacaaaaaacaaattatattaatgagaacatggaacagaatgaacagaaagagcagaagtcaagtgagctcatgaaagaagttccaggagatgactataagaacaaactcatcttcgcaatatctgtgactgtaatactaataattttgattataattttttgtcttatagaggtgaattcacataaaagggcatcagaaaaatacaaagacaacccatcaatatcaggagcctgagcatgagttaaagcatgtggatggcctggagc

SEQ ID NO: 148077 - DNA, 2209 bp, Homo sapiens
  Payload ID: 9303
  Gene Symbol: LRRC38
  Gene Name: leucine rich repeat containing 38
  Uniprot ID: Q5VT99
  ENST ID: ENST00000376085
  CDS Start-End: 456-1340
ggacacgccttagggaaaccgctcctgggcttggtagctgaacttagacgtcgagtgcagcccgcccggtgcgcgcggcgtcttactgccagatctcggaaatcagctgccagggtggggccgcgttttggcgacggccactcggccacccctgccgctcccgcctctcccaagagatttttctagcgggttaatttcctgtccgggtaaaccctttggtgagtccctcgcccctccctccccgcccctcccctctccatccctgctgtcccggctccccagtccgtccgcgccgcgctccatcgcccccgcacgcccgggcgcacgccctccccgcccgggccgccctctggctccccgcgcccggcagccagtgcctcaccgcgccgtcccgcgccagggctcgctccgagagccgcttccttctcgccgcggccggcgcgggccccccggccatgcgcccccgagccccagcctgcgccgccgcggcgctcgggctctgcagccttctgctgctgctcgcgcccgggcacgcgtgccccgcgggctgcgcctgcaccgacccgcacaccgtggactgccgcgaccgcgggctgcccagcgtgccagaccctttccccctggacgtgcgcaagctgctggtggccggcaaccgcatccagcggatccccgaggacttcttcatcttctacggcgacctggtctacctggacttcaggaacaactcgctgcgctcgctggaggagggcacgttcagcggctcggccaagctcgtgttcctcgacctcagctacaacaacttgacccagctgggcgccggcgccttccgctcggccgggaggctggtgaagcttagcctggctaacaacaacctggtgggcgtgcacgaggacgccttcgagaccctggagtcgctgcaggtgctggagctcaacgacaacaacctgcgcagcctcagcgtggccgccctggccgcgctgcccgcgctgcgctccctgcgtctggacgggaacccctggctgtgcgactgtgacttcgcccacctcttctcctggatccaggagaacgcatccaaactgcccaaaggccttgatgaaatccagtgctccctgcccatggagagcaggaggatatccctgcgtgagctgtcggaggccagcttcagcgagtgtaggttcagcctgtcactcacagacctctgcatcatcattttctccggtgtggccgtgtccattgcggccatcatctccagcttcttcctggccactgtggtgcagtgcctccagaggtgcgcacccaacaaagatgcggaggatgaagacgaggacaaggatgactgagccacctcctccctcctgcctcttactctccagcaccgaaccagaagctctctccaagacgagagggaaatgctgaaaatggaaaagcactggccaccatctgtgaactgaacagagcctgttccgtgtcttggcccctgggtacacctgctgggaccactgatctcagagtttagaatcagcagagcacagaagcccaggaaggatggagggaattattcctggagcataacctgcctctcagatcgaggtgtgtgttgggggagaagatgaccgagtcaggcttcatagctgatgactaaaagcctcccccaggaaatgtgaagactggcagctttcaatggcaaagatgattttacgccattctttttctgacctgtactgggagatcatgaaacatctgccttcctcccaagaaacagcagctcaaacagtggagattcaaattcggatcattcaccacaagaacgagaactttgatccttatataataggcctcagcaaccttgggatgttatactgggaactaataaactcgtgtgcaatagactcaatgtttatgttcccccagattttatatgttgaaacctaatccccaatgtgatggtatttggaggtggggcttttgggaggtgattaggtttagatcatatcatgaggatggggcccaaatgatgggattagtgccctcatgaaaggtggccccagagagctccttcaccccttcaatgcttgaggatgcagcaagaaatcagctgcccatgaaccgagaagcaggccctcaccagaacccagccatgctggcacccagatctcagacttccagcctccagaactgggagaaataaataaatgtctgttgtttgtaa

SEQ ID NO: 148078 - DNA, 1881 bp, Homo sapiens
  Payload ID: 9304
  Gene Symbol: LRRC39
  Gene Name: leucine rich repeat containing 39
  Uniprot ID: Q96DD0
  ENST ID: ENST00000342895
  CDS Start-End: 281-1288
aaaattagaactaggctgacattacatttcacttggttacagctgactggggattttaatcatttggagccacactgaaaaaaaaatttccccctgcaatctactcttaactgatagtcgctaactttggttatgtgtggtaagtatttgacaatgtcaatgaacagtctgaaacattgctttttttctctggtacatttaggtcctttctgaaatggtatctatgattcagctattcaaaacctaatgaagttggtgactatgacaatgtggagaaatcatgacagaaaatgtggtttgtactggggctgtcaatgctgtaaaggaagtttgggaaaaaagaataaagaaactcaatgaagacctgaagcgagagaaggaatttcaacacaagctagtgcggatctgggaagaacgagtaagcttaaccaagctaagagaaaaggtcaccagggaagatggaagagtcattttgaagatagaaaaagaggaatggaagaccctcccttcttctctgctgaaactgaatcaactacaggaatggcaacttcatagaactggtttgctgaaaattcctgaattcattggaagattccagaacctcattgtgttagatttatctcgaaacacaatttcagagataccaccagggattggactgcttactagacttcaggaactgattctcagctacaacaaaatcaagactgtccccaaggaactaagtaattgtgccagcttggagaaactagaactggctgttaacagagatatatgtgatcttccacaagagctcagcaatctgctaaaacttactcaccttgatctgagtatgaacgattttactacaatccctcttgctgtgttgaacatgcctgcccttgagtggctggacatgggaagcaacaaacttgaacaacttcctgatactatagaaagaatgcaaaatctacatacgttatggctgcaacgaaatgaaataacatgcttgcctcaaacaatcagcaatatgaaaaatctgggtactcttgttctcagcaacaataaactgcaagatattccagtatgcatggaagaaatggcaaatctgaggtttgtcaacttcagagacaacccactgaaattgaaagtatcacttcctcccagtgaaggcacagatgaagaagaggaacgggaattatttggccttcagtttatgcacacatacatacaagagtcacggagaagagcagatcaccaagtcaacggttcaactactttaccaatctccataaatacggatggataatataattcaagatgcccttctaaagaggattactttggtgaattctctaatgtttggatttctgaagtaaaaagaaaagctattaccaaagtttaatgaggccacagcattttttaaagttcatattatttgctatttaaagtatatatttttttgatataaaaatataattaaaaaattttttttggtggaagacagatgatgctcaaatttcttttccattaagcagttgtttctggtgatgaagaatgatttggtaaagcagttaacaaaacattttccaaagacaccagagggtctgtatagtactgcaaagcaggactgaatcccttctgctgcaaatactggattcgaccttggtcaatcagcaatttacaaagatgccctattttcttcttttcttcaacactaagaagcctaaattgaataaacacacacaaaacattgttaaaattttgcaaaagtttataaaaaattatttttgtcactatttattgagagactgttaactaacccataatgtactaagtactttgtcccatgcttccaagacacattatatttatgaccacaataaaagatgtgtatatttt

SEQ ID NO: 148079 - DNA, 1396 bp, Homo sapiens
  Payload ID: 9304
  Gene Symbol: LRRC39
  Gene Name: leucine rich repeat containing 39
  Uniprot ID: Q96DD0
  ENST ID: ENST00000370137
  CDS Start-End: 200-1207
atcatttggagccacactgaaaaaaaaatttccccctgcaatctactcttaactgatagtcgctaactttggttatgtgtgtctattcagaatattacattaattgatttctcaaacaaaggtcctttctgaaatggtatctatgattcagctattcaaaacctaatgaagttggtgactatgacaatgtggagaaatcatgacagaaaatgtggtttgtactggggctgtcaatgctgtaaaggaagtttgggaaaaaagaataaagaaactcaatgaagacctgaagcgagagaaggaatttcaacacaagctagtgcggatctgggaagaacgagtaagcttaaccaagctaagagaaaaggtcaccagggaagatggaagagtcattttgaagatagaaaaagaggaatggaagaccctcccttcttctctgctgaaactgaatcaactacaggaatggcaacttcatagaactggtttgctgaaaattcctgaattcattggaagattccagaacctcattgtgttagatttatctcgaaacacaatttcagagataccaccagggattggactgcttactagacttcaggaactgattctcagctacaacaaaatcaagactgtccccaaggaactaagtaattgtgccagcttggagaaactagaactggctgttaacagagatatatgtgatcttccacaagagctcagcaatctgctaaaacttactcaccttgatctgagtatgaacgattttactacaatccctcttgctgtgttgaacatgcctgcccttgagtggctggacatgggaagcaacaaacttgaacaacttcctgatactatagaaagaatgcaaaatctacatacgttatggctgcaacgaaatgaaataacatgcttgcctcaaacaatcagcaatatgaaaaatctgggtactcttgttctcagcaacaataaactgcaagatattccagtatgcatggaagaaatggcaaatctgaggtttgtcaacttcagagacaacccactgaaattgaaagtatcacttcctcccagtgaaggcacagatgaagaagaggaacgggaattatttggccttcagtttatgcacacatacatacaagagtcacggagaagagcagatcaccaagtcaacggttcaactactttaccaatctccataaatacggatggataatataattcaagatgcccttctaaagaggattactttggtgaattctctaatgtttggatttctgaagtaaaaagaaaagctattaccaaagtttaatgaggccacagcattttttaaagttcatattatttgctatttaaagtatatatttttttgatataaaaatataattaaaaaattttttttggt

SEQ ID NO: 148080 - DNA, 1466 bp, Homo sapiens
  Payload ID: 9304
  Gene Symbol: LRRC39
  Gene Name: leucine rich repeat containing 39
  Uniprot ID: Q96DD0
  ENST ID: ENST00000370138
  CDS Start-End: 200-1219
atcatttggagccacactgaaaaaaaaatttccccctgcaatctactcttaactgatagtcgctaactttggttatgtgtgtctattcagaatattacattaattgatttctcaaacaaaggtcctttctgaaatggtatctatgattcagctattcaaaacctaatgaagttggtgactatgacaatgtggagaaatcatgacagaaaatgtggtttgtactggggctgtcaatgctgtaaaggaagtttgggaaaaaagaataaagaaactcaatgaagacctgaagcgagagaaggaatttcaacacaagctagtgcggatctgggaagaacgagtaagcttaaccaagctaagagaaaaggtcaccagggaagatggaagagtcattttgaagatagaaaaagaggaatggaagaccctcccttcttctctgctgaaactgaatcaactacaggaatggcaacttcatagaactggtttgctgaaaattcctgaattcattggaagattccagaacctcattgtgttagatttatctcgaaacacaatttcagagataccaccagggattggactgcttactagacttcaggaactgattctcagctacaacaaaatcaagactgtccccaaggaactaagtaattgtgccagcttggagaaactagaactggctgttaacagagatatatgtgatcttccacaagagctcagcaatctgctaaaacttactcaccttgatctgagtatgaacgattttactacaatccctcttgctgtgttgaacatgcctgcccttgagtggctggacatgggaagcaacaaacttgaacaacttcctgatactatagaaagaatgcaaaatctacatacgttatggctgcaacgaaatgaaataacatgcttgcctcaaacaatcagcaatatgaaaaatctgggtactcttgttctcagcaacaataaactgcaagatattccagtatgcatggaagaaatggcaaatctgaggtttgtcaacttcagagacaacccactgaaattgaaagtatcacttcctcccagtgaaggcacagatgaagaagaggaacgggaattatttggccttcagtttatgcacacatacatacaagagtcacggagaagagcagctcttcagttttgtgtttgtcatggacagattctgacaatatatacatgtatggctctggaaatttgaagatcaccaagtcaacggttcaactactttaccaatctccataaatacggatggataatataattcaagatgcccttctaaagaggattactttggtgaattctctaatgtttggatttctgaagtaaaaagaaaagctattaccaaagtttaatgaggccacagcattttttaaagttcatattatttgctatttaaagtatatatttttttgatataaaaatataattaaaaaattttttttggt

SEQ ID NO: 148081 - DNA, 1951 bp, Homo sapiens
  Payload ID: 9304
  Gene Symbol: LRRC39
  Gene Name: leucine rich repeat containing 39
  Uniprot ID: Q96DD0
  ENST ID: ENST00000620882
  CDS Start-End: 281-1300
aaaattagaactaggctgacattacatttcacttggttacagctgactggggattttaatcatttggagccacactgaaaaaaaaatttccccctgcaatctactcttaactgatagtcgctaactttggttatgtgtggtaagtatttgacaatgtcaatgaacagtctgaaacattgctttttttctctggtacatttaggtcctttctgaaatggtatctatgattcagctattcaaaacctaatgaagttggtgactatgacaatgtggagaaatcatgacagaaaatgtggtttgtactggggctgtcaatgctgtaaaggaagtttgggaaaaaagaataaagaaactcaatgaagacctgaagcgagagaaggaatttcaacacaagctagtgcggatctgggaagaacgagtaagcttaaccaagctaagagaaaaggtcaccagggaagatggaagagtcattttgaagatagaaaaagaggaatggaagaccctcccttcttctctgctgaaactgaatcaactacaggaatggcaacttcatagaactggtttgctgaaaattcctgaattcattggaagattccagaacctcattgtgttagatttatctcgaaacacaatttcagagataccaccagggattggactgcttactagacttcaggaactgattctcagctacaacaaaatcaagactgtccccaaggaactaagtaattgtgccagcttggagaaactagaactggctgttaacagagatatatgtgatcttccacaagagctcagcaatctgctaaaacttactcaccttgatctgagtatgaacgattttactacaatccctcttgctgtgttgaacatgcctgcccttgagtggctggacatgggaagcaacaaacttgaacaacttcctgatactatagaaagaatgcaaaatctacatacgttatggctgcaacgaaatgaaataacatgcttgcctcaaacaatcagcaatatgaaaaatctgggtactcttgttctcagcaacaataaactgcaagatattccagtatgcatggaagaaatggcaaatctgaggtttgtcaacttcagagacaacccactgaaattgaaagtatcacttcctcccagtgaaggcacagatgaagaagaggaacgggaattatttggccttcagtttatgcacacatacatacaagagtcacggagaagagcagctcttcagttttgtgtttgtcatggacagattctgacaatatatacatgtatggctctggaaatttgaagatcaccaagtcaacggttcaactactttaccaatctccataaatacggatggataatataattcaagatgcccttctaaagaggattactttggtgaattctctaatgtttggatttctgaagtaaaaagaaaagctattaccaaagtttaatgaggccacagcattttttaaagttcatattatttgctatttaaagtatatatttttttgatataaaaatataattaaaaaattttttttggtggaagacagatgatgctcaaatttcttttccattaagcagttgtttctggtgatgaagaatgatttggtaaagcagttaacaaaacattttccaaagacaccagagggtctgtatagtactgcaaagcaggactgaatcccttctgctgcaaatactggattcgaccttggtcaatcagcaatttacaaagatgccctattttcttcttttcttcaacactaagaagcctaaattgaataaacacacacaaaacattgttaaaattttgcaaaagtttataaaaaattatttttgtcactatttattgagagactgttaactaacccataatgtactaagtactttgtcccatgcttccaagacacattatatttatgaccacaataaaagatgtgtatatttt

SEQ ID NO: 148082 - DNA, 1696 bp, Homo sapiens
  Payload ID: 9305
  Gene Symbol: LRRC3B
  Gene Name: leucine rich repeat containing 3B
  Uniprot ID: Q96PB8
  ENST ID: ENST00000396641
  CDS Start-End: 593-1372
attgactgagccgactgcatctctgggcaagcggcgctttgcctctctcctgtctttgtctgctcttcctgcaaggctacggcgcctggagcagggtctgcagcggccgccgcagcaacgcgagccaagtcgtgccccgcacggccgcccggggccgcaccctcgctcggtggcggcgcccgaagacgccagccgcgccacgcactgcctgcgtcccgcgccccagccgccgcgcaccaacgccgccgccttcgccgggagccaagcccgccgggccggcccggtcccaggtgggcagctcggcttgcagctggttggaggtggcggccgctgcagccctggcagcgggcacacccctaagcatacgcacccaacgcctcctccctgagccacgaggatggagcagccaccccggcccgggactggcgcaaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacaacgtgatctgtaaaacgtccgtgttggatgaacatgctggcagaccattcctcaatgctgccaacgacgctgacctttgtaacctccctaaaaaaactaccgattatgccatgctggtcaccatgtttggctggttcactatggtgatctcatatgtggtatattatgtgaggcaaaatcaggaggatgcccggagacacctcgaatacttgaaatccctgccaagcaggcagaagaaagcagatgaacctgatgatattagcactgtggtatagtgtccaaactgactgtcattgagaaagaaagaaagtagtttgcgattgcagtagaaataagtggtttacttctcccatccattgtaaacatttgaaactttgtatttcagtttcttttgaattatgccactgctgaacttttaacaaacactacaacataaataatttgagtttaggtgatccaccccttaattgtacccccgatggtatatttctgagtaagctactatctgaacattagttagatccatctcactatttaataatgaaatttatttttttaatttaaaagcaaataaaagcttaactttgaaccatggaaaa

SEQ ID NO: 148083 - DNA, 489 bp, Homo sapiens
  Payload ID: 9305
  Gene Symbol: LRRC3B
  Gene Name: leucine rich repeat containing 3B
  ENST ID: ENST00000414619
  CDS Start-End: 326-489
gaaataagagaggtgggacatggaggatggctgcggccacccctgaagcttcgtccagcgcgatgggagtcagtccatccttgcacacgccacccccaactcggcaatgaaacctttggagtggcttgcggctgtgcgccgtgggaactgcaagtgcagatatgggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatct

SEQ ID NO: 148084 - DNA, 1551 bp, Homo sapiens
  Payload ID: 9305
  Gene Symbol: LRRC3B
  Gene Name: leucine rich repeat containing 3B
  Uniprot ID: Q96PB8
  ENST ID: ENST00000456208
  CDS Start-End: 448-1227
atcagaaccacatcggaaatcaatgaaataagcattattcttagttctagttgaggaaactgacatgcggaacaattagttggcctgtccaagacctcctagctggtatcagaaatgaaagttgaacttgattttatctagcttcaggttctggatgatttctgtacattttgttgagaccaagaaagtttaaacggtccagggtggctccactggctcaaagggaaagaggatttagtaagtggcttgatttctcttctctgccttccattccactccacccccaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacaacgtgatctgtaaaacgtccgtgttggatgaacatgctggcagaccattcctcaatgctgccaacgacgctgacctttgtaacctccctaaaaaaactaccgattatgccatgctggtcaccatgtttggctggttcactatggtgatctcatatgtggtatattatgtgaggcaaaatcaggaggatgcccggagacacctcgaatacttgaaatccctgccaagcaggcagaagaaagcagatgaacctgatgatattagcactgtggtatagtgtccaaactgactgtcattgagaaagaaagaaagtagtttgcgattgcagtagaaataagtggtttacttctcccatccattgtaaacatttgaaactttgtatttcagtttcttttgaattatgccactgctgaacttttaacaaacactacaacataaataatttgagtttaggtgatccaccccttaattgtacccccgatggtatatttctgagtaagctactatctgaacattagttagatccatctcactatttaataatgaaatttatttttttaatttaaaagcaaataaaagcttaactttgaaccatggaaaa

SEQ ID NO: 148085 - DNA, 927 bp, Homo sapiens
  Payload ID: 9305
  Gene Symbol: LRRC3B
  Gene Name: leucine rich repeat containing 3B
  ENST ID: ENST00000432040
  CDS Start-End: 439-927
gggtacctgggggcgcgtggagacaaggaatggagccccggaatgccgggcccttgggtacttgggaaggcaggctgctgagtgcctgggatggggcgatcttcctccccagaagcaaacaaacctccccgcgagaatctgaatgcgttggcatcttgggtggtgactgaatggtcagatcgtggactagggatgcttctccaagctctaagaggaccatagtctgctctcttctctggcacccgcttgcttctacgctccttcacctctgcagccaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaat

SEQ ID NO: 148086 - DNA, 1695 bp, Homo sapiens
  Payload ID: 9305
  Gene Symbol: LRRC3B
  Gene Name: leucine rich repeat containing 3B
  Uniprot ID: Q96PB8
  ENST ID: ENST00000417744
  CDS Start-End: 592-1371
ggaaacgcagagctaggaggtgtgggcctcgggtgaggggagacccagctcttagacctgggagcccagacagaggtggatctgcccaccttgcagctcccagaggactcctgctgccttgtaccagttgggaaaaagcaaaattcagagcagttcctttttctgggtccctcgccttggccacatcggaggaaacgtcgactcgccagggctcccgggagaaatcccgaggtcagtccctcccattctggggcacccctggagcagctagctccctgcctagcggtggcaaactccagagccccaaggagcagaacggggattccctgtgcgcaggctcctggtgcagctcctgagcacaaaggccacaccctcacagaccaggcctggtgagagagccgggcttcttcagaagtacctggatacctgaggtgcccaagcaaggaaagaaataatgaagagacacatgtgttagctgcagccttttgaaacacgcaagaaggaaatcaatagtgtggacagggctggaacctttaccacgcttgttggagtagatgaggaatgggctcgtgattatgctgacattccagcatgaatctggtagacctgtggttaacccgttccctctccatgtgtctcctcctacaaagttttgttcttatgatactgtgctttcattctgccagtatgtgtcccaagggctgtctttgttcttcctctgggggtttaaatgtcacctgtagcaatgcaaatctcaaggaaatacctagagatcttcctcctgaaacagtcttactgtatctggactccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacaacgtgatctgtaaaacgtccgtgttggatgaacatgctggcagaccattcctcaatgctgccaacgacgctgacctttgtaacctccctaaaaaaactaccgattatgccatgctggtcaccatgtttggctggttcactatggtgatctcatatgtggtatattatgtgaggcaaaatcaggaggatgcccggagacacctcgaatacttgaaatccctgccaagcaggcagaagaaagcagatgaacctgatgatattagcactgtggtatagtgtccaaactgactgtcattgagaaagaaagaaagtagtttgcgattgcagtagaaataagtggtttacttctcccatccattgtaaacatttgaaactttgtatttcagtttcttttgaattatgccactgctgaacttttaacaaacactacaacataaataatttgagtttaggtgatccaccccttaattgtacccccgatggtatatttctgagtaagctactatctgaacattagttagatccatctcactatttaataatgaaatttatttttttaatttaaaagcaaataaaagcttaactttgaaccatggaaaa

SEQ ID NO: 148087 - DNA, 891 bp, Homo sapiens
  Payload ID: 9306
  Gene Symbol: LRRC3C
  Gene Name: leucine rich repeat containing 3C
  Uniprot ID: A6NJW4
  ENST ID: ENST00000377924
  CDS Start-End: 51-878
catagtcttccaaaatccagcaagaaaaatccttctcagaaaggtctccaatgcgtatgacctcatcttccttcgtatcctactgcactccaggactatgccaatttatggccatgctcccaacagcaggtcacctcctgcccctcctgctggtgataggcacagggggtactgtgcccagcccccaggtgcctccccggggctgttatgtggcaaaggaagcaggtgaacggacgttccgctgcagccaggcaggcctcagtgctgtgccctccggcatccccaatgacacccgcaagctctacctggatgccaaccagctggcatcggtgcctgctggtgccttccagcacctgcctgtcctggaggagttggatctgtcccataatgcccttgcccacctctcaggggcggctttccagggcctggagggcacattgcgccacctcgacctctctgccaaccagctggcctcagtgcccgtggaggcctttgtggggctacagatccaagtgaacctatccgcaaacccatggcactgtgactgcgccctccaggaagtgctccggcaggtgaggctggtgccgggcactgggacaggcatcgtgtgtggctcaggagcccgaccggacctcgtggggcaggagttcctgctgctggcaggggaggaagagctgtgtgggtcggggtggggtggggcccggaggagcaccgatgtggccctgctggtcaccatggggggctggctgacactcatggtggcttatctggtgcattatgtgtggcagaaccgagatgagaccaggcgctccctcaagcgggccccagtgctgcccgtgcgttccgaggactcctccatcctcagcacagtggtctgatgacccaggatgc

SEQ ID NO: 148088 - DNA, 3828 bp, Homo sapiens
  Payload ID: 9307
  Gene Symbol: LRRC4
  Gene Name: leucine rich repeat containing 4
  Uniprot ID: Q9HBW1
  ENST ID: ENST00000249363
  CDS Start-End: 259-2220
tccctcccctcccctcccctcccctctgccctccccgcccccaccacttcccccttttgttaattaaaactaagaagtcggaatgggaacgaggtgcccagctcccgtggagaaagcttaaggacaccacgccagtgctttcctgccttccttccgagatggaaagaggagctcctagctcacttaagccggggtagggctggttctcctttccgagccaaaatcccaggcgatggtgaattatgaacgtgccacaccatgaagctcttgtggcaggtaactgtgcaccaccacacctggaatgccatcctgctcccgttcgtctacctcacggcgcaagtgtggattctgtgtgcagccatcgctgctgccgcctcagccgggccccagaactgcccctccgtctgctcgtgcagtaaccagttcagcaaggtggtgtgcacgcgccggggcctctccgaggtcccgcagggtattccctcgaacacccggtacctcaacctcatggagaacaacatccagatgatccaggccgacaccttccgccacctccaccacctggaggtcctgcagttgggcaggaactccatccggcagattgaggtgggggccttcaacggcctggccagcctcaacaccctggagctgttcgacaactggctgacagtcatccctagcggggcctttgaatacctgtccaagctgcgggagctctggcttcgcaacaaccccatcgaaagcatcccctcttacgccttcaaccgggtgccctccctcatgcgcctggacttgggggagctcaagaagctggagtatatctctgagggagcttttgaggggctgttcaacctcaagtatctgaacttgggcatgtgcaacattaaagacatgcccaatctcacccccctggtggggctggaggagctggagatgtcagggaaccacttccctgagatcaggcctggctccttccatggcctgagctccctcaagaagctctgggtcatgaactcacaggtcagcctgattgagcggaatgcttttgacgggctggcttcacttgtggaactcaacttggcccacaataacctctcttctttgccccatgacctctttaccccgctgaggtacctggtggagttgcatctacaccacaacccttggaactgtgattgtgacattctgtggctagcctggtggcttcgagagtatatacccaccaattccacctgctgtggccgctgtcatgctcccatgcacatgcgaggccgctacctcgtggaggtggaccaggcctccttccagtgctctgcccccttcatcatggacgcacctcgagacctcaacatttctgagggtcggatggcagaacttaagtgtcggactccccctatgtcctccgtgaagtggttgctgcccaatgggacagtgctcagccacgcctcccgccacccaaggatctctgtcctcaacgacggcaccttgaacttttcccacgtgctgctttcagacactggggtgtacacatgcatggtgaccaatgttgcaggcaactccaacgcctcggcctacctcaatgtgagcacggctgagcttaacacctccaactacagcttcttcaccacagtaacagtggagaccacggagatctcgcctgaggacacaacgcgaaagtacaagcctgttcctaccacgtccactggttaccagccggcatataccacctctaccacggtgctcattcagactacccgtgtgcccaagcaggtggcagtacccgcgacagacaccactgacaagatgcagaccagcctggatgaagtcatgaagaccaccaagatcatcattggctgctttgtggcagtgactctgctagctgccgccatgttgattgtcttctataaacttcgtaagcggcaccagcagcggagtacagtcacagccgcccggactgttgagataatccaggtggacgaagacatcccagcagcaacatccgcagcagcaacagcagctccgtccggtgtatcaggtgagggggcagtagtgctgcccacaattcatgaccatattaactacaacacctacaaaccagcacatggggcccactggacagaaaacagcctggggaactctctgcaccccacagtcaccactatctctgaaccttatataattcagacccataccaaggacaaggtacaggaaactcaaatatgactcccctcccccaaaaaacttataaaatgcaatagaatgcacacaaagacagcaacttttgtacagagtggggagagactttttcttgtatatgcttatatattaagtctatgggctggttaaaaaaaacagattatattaaaatttaaagacaaaaagtcaaaacaaaaatattttctaacttgtaagttctatttaaagggggtgggggggaatcttgggaacgttgtggggtacaagccacaagttaacttgctatgctgccagaagggatttctggtataaggttgaaattgctgagataaaataaactaaaacaacaaacatccttaaagaggtagggtgtgggctgctgagggggcaagagggatagactgaatctgtcattttttagaagatgcttcataggacacaggactatccatttctacagacatctttcttaagccgagagctgtctttgcagaattatcttattaaaaaaaaatacaaaaaaaaagcaccatgaatttgtactgtgccaaaatgatagtggcaataatatttttcttcagaggctaaggggaagatagacctgtacatgtattttaagcaggaaaaccaccaaaattcaaacgaacccttaaaggggctgagtctttgtccatgtgcacaagtcttgggggtctgtgcactggacacacatgtgccttgcctgacagaattgcttagaaaggagcagagaaggacgggagctggcgtagctctcagtctaatgctttcacattgcaccagattcctgcagttgggcttaacccactctgcaaggcatgtgtctattcagggtttcccaggaggaggaggcccctgaaggggtgcggcagcaggggggtgggaagggagggtaaagcagagagaatgtattcacaggaggccataaattagcattgtgccatgtccacctgttgttcctggactctgacacatgattgtagacaatgatggcattttatgatttttaaaaaagattttgtttgttttaaggtggagagggaggagaagcctgaattggggagcttgggagtggaagcttttctcatgcttgtgatttggtgactcttctaaatgctgattcattagggattattacagcggatgtcaactggttgtggtgatggggtgggggcagaacatgagtagcaaagaaaagggagagacgaaaagggtacaggctcacgtaaagtaatgaagcctttcccaaccaggatggttcacaaaaaagctgtgagatccacagttacaagtgacacgcatgcacacatggagttccacatggggtactgttgaatggagcacactgatgggaagcttccctctcccaggccccctcaggagaaggtggaagagaaagggtgggcgtgggtggggaaggcagagatctctgttattctggtccatctaatgatgtaacttctttcagttattattttagctttaaaaggaaataaggggttcagatttgaaagggggtggtatgggtgggggaggggaattgccaacaaaagaacactgattgtaatgtgagaaaagtgtatttttgtattttaataaatattgttgaatttttaa

SEQ ID NO: 148089 - DNA, 451 bp, Homo sapiens
  Payload ID: 9307
  Gene Symbol: LRRC4
  Gene Name: leucine rich repeat containing 4
  ENST ID: ENST00000478726
  CDS Start-End: 300-451
tggtcctcgggggccggacggagcgccgccccgcgtgccggcagccggcggactggagaactgaccccccgtttttgtctcttccaccctccgagaagaggcgaggagaaaggggaagtcggaatgggaacgaggtgcccagctcccgtggagaaagcttaaggacaccacgccagtgctttcctgccttccttccgagatggaaagaggagctcctagctcacttaagccggggtagggctggttctcctttccgagccaaaatcccaggcgatggtgaattatgaacgtgccacaccatgaagctcttgtggcaggtaactgtgcaccaccacacctggaatgccatcctgctcccgttcgtctacctcacggcgcaagtgtggattctgtgtgcagccatcgctgctgccgcctcagccgggccccagaactgcccctccgtctgctc

SEQ ID NO: 148090 - DNA, 561 bp, Homo sapiens
  Payload ID: 9307
  Gene Symbol: LRRC4
  Gene Name: leucine rich repeat containing 4
  ENST ID: ENST00000476782
  CDS Start-End: 278-561
acattcacgttctgactgaaggacaaaaggatgagagagcagtctgcgtggctgccgcctgcaacaccgcgagcccggcgcgaggaggagacgaagtcggaatgggaacgaggtgcccagctcccgtggagaaagcttaaggacaccacgccagtgctttcctgccttccttccgagatggaaagaggagctcctagctcacttaagccggggtagggctggttctcctttccgagccaaaatcccaggcgatggtgaattatgaacgtgccacaccatgaagctcttgtggcaggtaactgtgcaccaccacacctggaatgccatcctgctcccgttcgtctacctcacggcgcaagtgtggattctgtgtgcagccatcgctgctgccgcctcagccgggccccagaactgcccctccgtctgctcgtgcagtaaccagttcagcaaggtggtgtgcacgcgccggggcctctccgaggtcccgcagggtattccctcgaacacccggtacctcaacctcatggagaacaacatccagatgatccaggccgacacctt

SEQ ID NO: 148091 - DNA, 557 bp, Homo sapiens
  Payload ID: 9307
  Gene Symbol: LRRC4
  Gene Name: leucine rich repeat containing 4
  ENST ID: ENST00000494115
  CDS Start-End: 322-557
aaaactaagaagtcggaatgggaacgaggtgcccagctcccgtggagaaagcttaaggacaccacgccagtgctttcctgccttccttccgaggtaactgtgcaccaccacacctggaatgccatcctgctcccgttcgtctacctcacggcgcaagtgtggattctgtgtgcagccatcgctgctgccgcctcagccgggccccagaactgcccctccgtctgctcgtgcagtaaccagttcagcaaggtggtgtgcacgcgccggggcctctccgaggtcccgcagggtattccctcgaacacccggtacctcaacctcatggagaacaacatccagatgatccaggccgacaccttccgccacctccaccacctggaggtcctgcagttgggcaggaactccatccggcagattgaggtgggggccttcaacggcctggccagcctcaacaccctggagctgttcgacaactggctgacagtcatccctagcggggcctttgaatacctgtccaagctgcgggagctctggcttcgcaacaaccccatcgaaag

SEQ ID NO: 148092 - DNA, 2884 bp, Homo sapiens
  Payload ID: 9308
  Gene Symbol: LRRC40
  Gene Name: leucine rich repeat containing 40
  Uniprot ID: Q9H9A6
  ENST ID: ENST00000370952
  CDS Start-End: 81-1889
gaaaggagcggggcatcccaacggcgccacctttaagcgtcacgggtggggctgcagcttctggacctaggactttgaacatgtcgcgcctgaagcggatagcggggcaggatctccgcgctggtttcaaagcaggtggaagagactgcggtacctcggtaccccaagggctgttgaaggcagcgaggaagagcggccagttaaacctgtcgggtagaaacctcagtgaagtgccgcagtgtgtctggagaataaatgtggatatccctgaggaagctaatcagaatctttcgtttggtgctactgaaagatggtgggagcagacagatttgaccaaactaataatatcaaacaataaacttcagtcacttacagatgacctgcgactcttgcctgcactgactgttcttgatatacatgataatcagttgacatcccttccttctgctataagagagctagaaaatcttcagaaacttaatgtcagccataataaactgaaaatactccctgaagaaattacaaacctaagaaacctgaagtgcctgtatctccagcataatgaattaacctgcatatcagagggatttgaacaactttccaatttagaagatttagatctttcaaacaatcatcttacaactgttcctgctagtttttcttctctgtccagtctggtgcgactcaatctttctagtaatgaactgaagagtttgccagcagaaataaatagaatgaaaaggttgaagcatttggattgtaattcaaatctcttggaaactatacctcctgaattggctggcatggaatcactagaattgctttatttgcggaggaataaattacgttttctaccagaatttccttcttgtagtctattgaaggaattgcacgtaggtgaaaaccagattgaaatgttagaggcagaacatcttaaacatctgaattcaattcttgtgctagacctgagggataacaagttaaaatctgttccagatgaaattatactactacggtccttggaaaggcttgacctaagcaacaatgatattagtagtcttccctattcattggggaaccttcatttgaaatttttggcattagaaggaaatcctttgagaacaattcgaagagaaattataagtaaaggaacacaagaagtcctaaaatatctacgaagcaagatcaaagatgatggacctagccaaagtgagtctgctactgagactgccatgacactaccaagtgaatccagagtcaatatacatgccatcattacattaaaaatattagactatagtgataaacaagcaactttgattcctgatgaggtgtttgatgcagtaaaaagcaacatcgtcacttctattaacttcagtaagaatcaactatgtgaaattccaaaaaggatggtagaactgaaggaaatggtttctgatgtcgatctcagttttaataaactttcctttatatccttggagttatgtgtgcttcagaaattgacttttttagatctcaggaacaattttttaaattctttgccagaagaaatggaatcactggtaagactgcaaacgatcaatctttcctttaataggtttaaaatgctacctgaagttctatatcgtatcttcacacttgaaacaattctgattagtaataatcaggttggatctgtggaccctcagaaaatgaagatgatggaaaatctgaccacgttggaccttcaaaataatgacctcttacaaattccaccagagctcggtaattgtgtaaacttaagaacattactactggatggaaatccattccgagttcctcgagcagccatattaatgaaaggaacagctgctatacttgaatatttgagagaccgaattcctacttaacatggagttgctttataacccttgtcatgtattattaaccctggttaattctaaggaggatgtaacatttgttttagtatcatcttaaaaggtgattattgtaattgatcttgtagtttcccagtatcacctacctgttggtataattagcctgggccatattcactgccagtaaatatttttacatttttatttaagatttttgtaaggtgttgtatacatttgtaatggtgataaccacaatgtgttcatacatttgttctaaatgttttgcttatgatttatcctgctaactttcattttcttatagcaagcagttttttcaaaaatgaatttttatttaatgtggttcagtattataataacaaagcatttttgtagaactggttttttttctcatttatttttgtattccatacaatgtgaccaattgacttgaatatgactagccagtttctatgtttttgttagatataaaattaaatcgaattttgttgaatactgttctttggcatttaaaaaataagaccttcttatcttgggccacatgtcaaaagaaaaaggaaacaaaaatatattaaaaataagacttttcattacccatgataggacttttgtgatatggctaatctcagtacacatttcaacttaaaacctttttatttacagcaccataattttaaaatttacttgcaatcttggtaagactaaacttgcagtgtttttctaaaagggaatttgataggtaaacttgatttaataaaaattaaatatcatttttgtttacaccaaaattatcagaagtaggttgattagtcattataacacttaccatatgattctattaagaagtcaattcagtagcatgtatatcaatttatatagataggtagatagcttttggatgattgaggcatgcttatattatgaaaaaaattgctaataaagataaatactacatgttcagaataaaagttacatttttcaaatattga

SEQ ID NO: 148093 - DNA, 2947 bp, Homo sapiens
  Payload ID: 9309
  Gene Symbol: LRRC41
  Gene Name: leucine rich repeat containing 41
  Uniprot ID: Q15345
  ENST ID: ENST00000343304
  CDS Start-End: 45-2483
ggcggtccgcgggcgacactctcgggctcgcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatc

SEQ ID NO: 148094 - DNA, 4128 bp, Homo sapiens
  Payload ID: 9309
  Gene Symbol: LRRC41
  Gene Name: leucine rich repeat containing 41
  Uniprot ID: Q15345
  ENST ID: ENST00000617190
  CDS Start-End: 287-2725
atgtactaccagccgcaggcagaggttaggggtagctgatgtttgcacccgaggaggctttgctaagaaacatccccttagtcataccacacccaagtataattgatctaggagtttatctaaaatagtagctcctaagagacttggaaagtgtgctaatttcttcgaaatttctttagaataattcacattcttccccatatcgcttatggagccgtcctaactgctgaccttttcaagatggcggtccgcgggcgacactctcgggctcgcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatcatgcagcccttcttgatgattttctcccagagaacaaaattcaacagggccctgtggagcaaggagccccttttccctatctccttcctctaagagctacacccagaccagctggttatcagcggaggccccgctgctcctcatgagaacgctggtggaagacgaaggtgatggcagtggaggcagcatcccaggcagcctggagtacctcatcccggagcccccacttatcagtgcagtggttccaccctgccaggtctgaagtgcagtcagaaccatcagggggtggccggatctgacggctgttgacacaacgtcggcagtgcaacctagggacagaaggcacagctgaagtcactacagatcccatctccctactgtgtgggtagcttagagataatggttagggcacttccccacctgtcatgtgtgtcactgaggctagcttcatccaggataaacagctccttcaactcgcccagagagaagtggcgctctacatcctgctcctcatccaccacacagctgctcagtgccttcttgtggctctgacgctggaagatcttctcctcaatggtccctgcctggggaagaggaggtggggaatgtcaaaagatacagcgcttagccatcctcataaaaagggagcaggaaaaccaaagggttgaaactacagctacccgagaagaggagatgaataaaaagtatgagtcccagaacattatctctactcagctgaggtccattttcccagtctgtctcctgagaacatgacatgaatagtctgcccacccaggctactttctatactaatgaagggtcccagggcctggctaaatcccgtcagggtgaactgaggtttgtctgctgcagcttcagatttctgcaccaagcccaactctaactcattcaataaatatcatttaggtatctattcta

SEQ ID NO: 148095 - DNA, 892 bp, Homo sapiens
  Payload ID: 9309
  Gene Symbol: LRRC41
  Gene Name: leucine rich repeat containing 41
  ENST ID: ENST00000496156
  CDS Start-End: 1-684
ccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagctggagttatactcccaaagacaaggcagggctcctctctgatgtggcaaacaaggctagattcttacctaggatgccggaattaacaaaatgtaccaagctgaaatactcaagcagatcattctggatgggagttccggagatgagcacccgccggctggtgttcaagctgtccagggcttgactgctgagagtcaagtacctcgtcacatatgaccagaccaacacttcctttctggaggactccaacatgaaggcggaaggtctcataggaaatgatgaggatgggagaagacaccctggctccacgctggttcatgaatccttctacaacagaaaaggtgtaaagggaacaattcagaatcttttgaaaaaaaaaaaaacaaaaaaaa

SEQ ID NO: 148096 - DNA, 4455 bp, Homo sapiens
  Payload ID: 9309
  Gene Symbol: LRRC41
  Gene Name: leucine rich repeat containing 41
  ENST ID: ENST00000472710
  CDS Start-End: 1652-3514
tttattttatttgtgagacagagtcttgctctgtcgcccaggctgaagtgcagtggcgccatctcggctcactgcagtctctacctcctgagttcaagtgattcttgtgcctcagcctcccaagtagctgggattacaggcgtgcatcattacacctggctaatttttgtatttttagtagagatggggtttcaccatgttggtcaggctggtctcaaactcctgacctcaagtgatctgcccgccttggcctcccaaagtgctggtattacaggtgtgaaccattgcatcccacctattttttattttttgaggcagggtcttgctctgtcatccaggctggagtgcagtggtctaagcacagctcacttcagcctcaacctcctgggctccagccatcctcccaccttagcctcccaagtagctgtgaccacaggtgcacaccatcacactctgctaatttttgttttgttttgagatagggttctcactgtgtcacctgggctcaagtacagtggtgtgatcatagctcactgtagcctcgaactcctgggcttaagcgatcctcttagcctcccaaagtgctgggattacaggtgtgaaccactgtgcccagcctccatttttttccagttgaagaaactaaggcttaaagaggcttaaataatttgtccaaggattcacatttaactaagtagttaggattgcactcagatttgtcctactctagaggccaaaccctttagacactatactataacagctcttagaactagagaagttggcaagagcaggttttgtttttaagatatattgactttagagacacgaattgtttctattcttcataggaaagtactagttcagaatatagcagtagcccaaaggatggtagtggttaatctggaaaaatggaaaaggaattcaggaaagacttaataaagggcatgtgatacttgaaagatgagtagttgatatactgaaagtggcaacgacattcctattagaacagcatgacaaaggacattcctattggaaagaacagcatgacaaaggtacaggggcagaaagcggcataatatgttaggtaaatgaaaaagtagttaagtgtggctgaaatgtaggaggcaaagcagggagctgatactagcagggcagattatgaaagaccttttatcacacatattcagtaggtccttttcaatgccaaatggttcattttgcttgggcagaagtgaactgaccagctcctaaataagcatgtcaagctcatttagcatgtcagcttgttttgtgggatgatctcacccttgcccctgaaattccagcttccaactgagtggctgaagataagtggactagagtttggaacagatctagattagcttctagaggttccatttgtcaaatgagaagtctacccttccattttcctttccagtagaataaataatgcttggaaacctcttgggtgggagggggaggggaggaaaagtaaacttttgttttgatttttgtagccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctgggtgggggccagaccctggggagggagaggggaaaggagctaggcctttgacctaaaaactcactggataaaggcaaagacctctccactgggaacgtgggagttggaatacagatatttctgtgctggggcttcaggaaccagcagggctggttctgccagccatagttgggttgggatacccttgtcccctgttcttgggtggaggtgataggcgttctccccttctctccagggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaac

SEQ ID NO: 148097 - DNA, 2068 bp, Homo sapiens
  Payload ID: 9309
  Gene Symbol: LRRC41
  Gene Name: leucine rich repeat containing 41
  ENST ID: ENST00000498402
  CDS Start-End: 19-1584
gtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggtgagcaccctggagtggcagggattgggcttagattgcctagcagcaccagctgtgtgcctaattctagggaggtgggaggggcaaattgggggtatgatcaggaggttagagaggaaggcttgtatgcctcatagcaggggagactgtcattgctagaagagaggaacataaagtctatacacttgattagttgttgaaagcaggggttcctgaggggcagtgagacaagccagctggaatctgaagaatgaatacattttagatatggaaggcagtccaagggcaggtgggagcagtatagtatatgcatgctcaggcagggctagagtttgacctcaccacctcaccagtcatattttaagtattcttgataatttgatctaacaatcctcacaaccctatgagggcaagtgacttcctcaggataacctagcaattatagagctaggattcaaaacccaggcaaccagactgcagattcatgctttcaaacaactatgctactctcctttccaccgtctctctcctatcagcattttaacaggtctccatcaaaaactgccaccaccacctccctctatgccatattaataaactgttatctcctgttcttcacaa

SEQ ID NO: 148098 - DNA, 2158 bp, Homo sapiens
  Payload ID: 9309
  Gene Symbol: LRRC41
  Gene Name: leucine rich repeat containing 41
  ENST ID: ENST00000617760
  CDS Start-End: 1-1854
atgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatc

SEQ ID NO: 148099 - DNA, 2842 bp, Homo sapiens
  Payload ID: 9309
  Gene Symbol: LRRC41
  Gene Name: leucine rich repeat containing 41
  ENST ID: ENST00000615587
  CDS Start-End: 8-2380
aacgaccatggaggccacgtcccgggaggcggcgccagcgaagagctcggcctcgggccccaacgctccccccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccatctggcgccgactctgggatgaactgatgaagacaaggccttccagtttggaaagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaagagtacaacctagccctgaaaagactgagcttccatgacatgaatctcgctgactgtcagagcgaggtgctctttttgctacagaatctgactctgcaagagattaccttctccttctgccgtctgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaaca

SEQ ID NO: 148100 - DNA, 1727 bp, Homo sapiens
  Payload ID: 9310
  Gene Symbol: LRRC42
  Gene Name: leucine rich repeat containing 42
  Uniprot ID: Q9Y546
  ENST ID: ENST00000319223
  CDS Start-End: 212-1498
cttgctcccgcccccgccggtcccgcggtcccacggcgcctggttgcccccagccccctccctcctcccaccttcactgtgtcccacccttcctagctttgtgcccggggtgctgagcccttccccgtcagccgggccgcgggaggagggagccgtcaccgaggagctgccgctcgctgccccgggcaggggcacagttgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctagtgtaactcagctccacctgaaggataattgtttatctgatgctggggtgcggaagatgacagcaccagttcgagtgatgaaaagaggccttgagaatctaacattattagacttatcatgtaaccctgagatcacagatgcaggcattggatacctcttttcttttaggaaactaaactgcttagatatctctgggacagggctcaaggacatcaaaaccgtcaagcacaagctccagacccacataggccttgttcactccaaagtgcctttgaaggaatttgatcatagtaactgcaagacagagggctgggctgaccagatcgttctgcagtgggagcgtgtgactgcggaagctgtgaagccacgggagacctcggagcctagagcagcagctcagcgcttctatgggaagcggtctcgagcagaagccccactgaagtgtcccctggcagacacccacatgaactcttccgagaaactccagttctataaagagaaagccccagattgccatgggccagtgttgaaacacgaagctatctcaagccaggagtcaaagaagagcaagaagagaccttttgaggagtcagagacagaacagaataactcttcacaaccttcaaagcagaaatatgtatgtcttgctgtggaagactgggacttgttaaattcctattgattagtagatacaagttgacctttctctggcccccagctctagtgtttgagtaaaggagactgaggatgatttactttttgtttgaatttacctatggcattagcatagtaagcagatatttctacttttgtggtgtgggaggggaatgctatggaagtatgtaataatttctaatgtatattttcaatacatagtaattttttcaaataaacatttttgctgtccttaa

SEQ ID NO: 148101 - DNA, 838 bp, Homo sapiens
  Payload ID: 9310
  Gene Symbol: LRRC42
  Gene Name: leucine rich repeat containing 42
  ENST ID: ENST00000371368
  CDS Start-End: 262-838
gcgggccaagatgcgaaaccactcctctttgtgcccggggtgctgagcccttccccgtcagccgggccgcgggaggagggagccgtcaccgaggagctgccgctcgctgccccgggcaggggcacaggttgatgtcatatttttagtcttgagaaacagcatcatgccaaggaaagagcttgagctttggagtaatgcggccctgagattgaattctggctctgccacttattagctctgttctagattgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctag

SEQ ID NO: 148102 - DNA, 2037 bp, Homo sapiens
  Payload ID: 9310
  Gene Symbol: LRRC42
  Gene Name: leucine rich repeat containing 42
  Uniprot ID: Q9Y546
  ENST ID: ENST00000371370
  CDS Start-End: 522-1808
attacttcgcgggccaagatgcgaaaccactcctgtgcgcctttccccaggccagtcccggggcgcgcgctgcctaccctcccccagctcagctctatccccggggcccgcaggacccaggggacccaccctcccgcgagcacgcacgcgcagggcccacctctgcgagttccaaaccctcggccctcgggtcgcctgccctgggcctggccccgcctccaggtccggccccgccttcgtgccggggcccgcgcacgcgcgcctccccggcccagccttgctcccgcccccgccggtcccgcggtcccacggcgcctggttgcccccagccccctccctcctcccaccttcactgtgtcccacccttcctagctttgtgcccggggtgctgagcccttccccgtcagccgggccgcgggaggagggagccgtcaccgaggagctgccgctcgctgccccgggcaggggcacaggcttcatccagtgaatactagagggatcgaacagttgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctagtgtaactcagctccacctgaaggataattgtttatctgatgctggggtgcggaagatgacagcaccagttcgagtgatgaaaagaggccttgagaatctaacattattagacttatcatgtaaccctgagatcacagatgcaggcattggatacctcttttcttttaggaaactaaactgcttagatatctctgggacagggctcaaggacatcaaaaccgtcaagcacaagctccagacccacataggccttgttcactccaaagtgcctttgaaggaatttgatcatagtaactgcaagacagagggctgggctgaccagatcgttctgcagtgggagcgtgtgactgcggaagctgtgaagccacgggagacctcggagcctagagcagcagctcagcgcttctatgggaagcggtctcgagcagaagccccactgaagtgtcccctggcagacacccacatgaactcttccgagaaactccagttctataaagagaaagccccagattgccatgggccagtgttgaaacacgaagctatctcaagccaggagtcaaagaagagcaagaagagaccttttgaggagtcagagacagaacagaataactcttcacaaccttcaaagcagaaatatgtatgtcttgctgtggaagactgggacttgttaaattcctattgattagtagatacaagttgacctttctctggcccccagctctagtgtttgagtaaaggagactgaggatgatttactttttgtttgaatttacctatggcattagcatagtaagcagatatttctacttttgtggtgtgggaggggaatgctatggaagtatgtaataatttctaatgtatattttcaatacatagtaattttttcaaataaacatttttgctgtccttaa

SEQ ID NO: 148103 - DNA, 1044 bp, Homo sapiens
  Payload ID: 9310
  Gene Symbol: LRRC42
  Gene Name: leucine rich repeat containing 42
  ENST ID: ENST00000444987
  CDS Start-End: 327-1044
tcccgcccccgccggtcccgcggtcccacggcgcctggttgcccccagccccctccctcctcccaccttcactgtgtcccacccttcctagctttgtgcccggggtgctgagcccttccccgtcagccgggccgcgggaggagggagccgtcaccgaggagctgccgctcgctgccccgggcaggggcacaggttgatgtcatatttttagtcttgagaaacagcatcatgccaaggaaagagcttgagctttggagtaatgcggccctgagattgaattctggctctgccacttattagctctgttctagattgcaaccaaggcaatgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctagtgtaactcagctccacctgaaggataattgtttatctgatgctggggtgcggaagatgacagcaccagttcgagtgatgaaaagaggccttgagaatctaacattattagact

SEQ ID NO: 148104 - DNA, 2028 bp, Homo sapiens
  Payload ID: 9311
  Gene Symbol: LRRC43
  Gene Name: leucine rich repeat containing 43
  Uniprot ID: Q8N309
  ENST ID: ENST00000339777
  CDS Start-End: 29-1999
gcggttgccgggcaacgcggcccgggccatggaggcgtcgtacgagtccgagtccgagtccgagtctgaggccgggcctgggactcagcggcccgggaccgggaccgtgagcgcggccgtgcgcgagcacttgcggaagctgtgtctgcgcgagttcccgtgcggtgccggcagctggaataagtcgcgctttcttcctcaaacttggcgaacttggagggagcttgtccccagagaggaggatgtggtgagccccggagaggagacggtggaggccctgctgggcctggtccgcagccgccactccccctgggctctgctgaacaactcgaatgcagaagacagtttcctgagagaattggccatccggaacccgctgacgatcacagacaccttcttctactcctacttccggtccctgcgggtaatagacaagaaggtcaccctggtggataaagacctcctgaaatttctaaagctggaggagttggtactgagcgccaatcgaatcaaggaggtggatgccaccaatctgccccccacactcaaggtgctggagctctacggcaatgagatcagcagcatggagtgtctgtgtgcccacccacccgccggcctgcagcacttggggttaggccacaacaaacttctaggccccttggaaagtctctacgtcaccgctaatcactggcccaacctcgtctccctggacctgggcttcaacgacctgacagacctgcagagcatggtcaccagcctgaggaccctccggcacctgcgactcctggtgctgcagggaaacccactggccttggtgccctactaccgcggcctcaccatcgacagcctggcccagctctgcgtgctggacgacatcaccgtgtctcccaatgagaagcatctcttccgggggctcagcctcaatggcgatctcttggcacaggaggcgcagtttgtggtgaccatcggaaacatcagaggagtcctggacacctctgtcttagacccggaacccaggcccgaaggccctttcatcacttacaactattacgtgacctatgattttgtgaaagatgaagaaggcgaaatgaatgagtccgcgggcgtcctggccgagatcgtcaagccctctcccagcttagaattattagttgaggaatctcctgaagaggtcgtggaagacgtcatcgaagacattgttgaagaggttactgaagaggtcgaagggtctctggagtctgaggtggaggagtcaggagagtcggagctgtctgtcatctcggggccttcgaccatcttgcagatgccgagggcctctgcagaagagctggccaagttgaggctgcgtatagatccccggctctgcccgtccccagggactgtcctcttcagcactgcccacaagccctgggctgaggtcatcccctgcagttacgagatgcagcactctctcagggacctggtcccactgaaggccttcctgctggcggggaccaccgtgaccatcgtggaggagaagattctctcctggcctgtggtgctacctgctgttgacagtcccctgtctgccaagaaaggaaagggggagaaagacaagaaagggaaggagaaagacaggacggggaaaggagagaaagagccggccaaggagtggaaggtgctgaagaagaagaaagagccgcccaaggagctccggcaggacccccccatcctccaggtgctgggccggggcctggtgatcctggagcccctgctcgccggggagcccctggtgtccaccgtgtgcaacttcggcgtggtccgcacattgacatctgacaggctgacgttggccagggattcaaagaagattaagaaagttgccaaaaaagaaaagccgaaagccgtgattccgatctacgaaggcgattaccaccctgagcccctgaccgtagaggtgcagatccagctgaaccagtgccgctcggcggaggaggctctgcgcatgttcgccgtgtagggcgtgggcagtaaaggctgttcccagca

SEQ ID NO: 148105 - DNA, 891 bp, Homo sapiens
  Payload ID: 9311
  Gene Symbol: LRRC43
  Gene Name: leucine rich repeat containing 43
  ENST ID: ENST00000537729
  CDS Start-End: 451-891
caatgaggtcgccactagccactgcagctgtcgagcacgcaagataataagtcgcgctttcttcctcaaacttggcgaacttggagggagcttgtccccagagaggaggatgtggtgagccccggagaggagacggtggaggccctgctgggcctggtccgcagccgccactccccctgggctctgctgaacaactcgaatgcagaagacagtttcctgagagaattggccatccggaacccgctgacgatcacagacaccttcttctactcctacttccggtccctgcgggtaatagacaagaaggtcaccctggtggataaagacctcctgaaatttctaaagctggaggagttggtactgagcgccaatcgaatcaaggaggtggatgccaccaatctgccccccacactcaaggtgctggagctctacggcaatgagatcagcagcatggagtgtctgtgtgcccacccacccgccggcctgcagcacttggggttaggccacaacaaacttctaggccccttggaaagtctctacgtcaccgctaatcactggcccaacctcgtctccctggacctgggcttcaacgacctgacagacctgcagagcatggtcaccagcctgaggaccctccggcacctgcgactcctggtgctgcagggaaacccactggccttggtgccctactaccgcggcctcaccatcgacagcctggcccagctctgcgtgctggacgacatcaccgtgtctcccaatgagaagcatctcttccgggggctcagcctcaatggcgatctcttggcacaggaggcgcagtttgtggtgaccatcggaaacatcagaggagtcctggacacctctgtcttagacccggaacccaggcccgaa

SEQ ID NO: 148106 - DNA, 2701 bp, Homo sapiens
  Payload ID: 9312
  Gene Symbol: LRRC45
  Gene Name: leucine rich repeat containing 45
  Uniprot ID: Q96CN5
  ENST ID: ENST00000306688
  CDS Start-End: 343-2355
cttgttcttcctggatactgaggccccgacgcggctgtcgcgagggcgggggtcggggctgcaggcggggcagggctgggtgggggcgcgcgacgcacctgcctgcttcctgcacgggtggtccccaagcactgcggggccccagcccaaagcggaccttgactaccgcccagccccgcgctcccaggacctcccgcccgcggagcccactcggattgctctccgcccgggtcggcggaggccccgtctcctgtacccggcgctgggactgctccgcaccgcgcggctccctttcagcagctgcgggagcatgcggaggaggccctgccggccccgcgggtcatggaggagttccggcgctcctacagccgcctgtgcagggagagtggggccgagccccaggaggctgtcctgcagcagctgcaccagcttcccaggggccggctggacctggccacgcaaagcctgacggtggagacctgcagggccctgggcaagctgctgccgagggagacgctgtgcacggagctggtcctgagtgactgcatgctcagcgaggaaggggccacactgctgctccgaggcctgtgtgccaacaccgtgctgcgctttctggacttaaagggcaacaaccttcgggctgcaggggccgaggctctgggaaaactcctccaacagaacaagtccattcagagcctcacgctggagtggaacagcctgggcacgtgggacgatgccttcgccaccttctgcgggggcctggcggccaacggcgccctgcagcggctggacctccgcaacaaccagatcagtcacaagggcgcggaggagctggccctagccctgaagggcaacaccaccctccagcagctggacctgcgctggaataacgttggcctcctggggggccgggccctcatgaactgtctccccagcaacagaaccctgtggagactggacctggctgggaacaacatccctggagacgtcctcagagccgtggagcaagccatgggccacagccaggaccggctcaccaccttccaggagaaccaagcccgcactcacgtcctcagcaaggaggtccagcacctccgggaggagaagtccaagcagttcctcgacttgatggagactattgataagcagcgagaagagatggccaagagcagcagggcgtcggcagcccgtgtagggcagcttcaggaagccctgaatgagaggcactccatcatcaacgctctcaaggccaagctgcagatgacagaggccgccctggctctgtcggagcagaaggcccaggacctgggggagctcctggccacagcggagcaggagcagctgagcctgtcacagaggcaggccaaggagctcaagctggagcagcaggaagctgcagagcgggagtctaaactcctcagagacttgtctgctgccaatgaaaagaacctgcttctgcaaaaccaggtagacgagttggagcggaagttcaggtgtcagcaggagcagctgttccagaccaggcaggagatgaccagcatgtcagctgagctgaagatgcgggccatccaggccgaggagcgcctggacatggagaagagaagatgcagacagagcctggaggactccgaaagcctgcgcatcaaggaggtggagcatatgacccgtcacctggaggagagtgagaaggccatgcaggagcgggtgcagaggctggaggcggcgcggctgtccctggaggaggagctgagccgagtgaaagcagcggcactcagcgagcgtggccaggctgaggaggagctgatcaaggccaagagccaggcccgcctggaggagcaacagcgcctggctcacctggaggacaagctgagactgctggcgcaggcacgggacgaggcgcagggcgcttgcctacagcagaagcaggtggtggccgaggcccagacccgggtcagccagctgggcctgcaagttgagggcctgcggcggcgcctggaagagctgcagcaggagctgagcctcaaggaccaggaaagggtggccgaggtgagcagggtgcgcgtggagctgcaggagcagaacggccggctgcaggcggagctggcggctcaggaggcgctgagggagaaggcggcggccctggagcgccagctgaaagtgatggcgagcgaccaccgagaggcgctgctggacagggagagcgagaacgcgtctctccgggagaagctgcggctccgggaggcggagatcgcccgcatccgggacgaggaggcccagagggcgagcttcctgcagaacgccgtcctggcttacgtgcaggcgtcccccgtgaggaccctgagccccccaaagtgagacaggccgggaggacccgggcgcagtaggagtgcatcaggcggcgcccgagatggaccaggggctgcgtcccgcccgcgccgcctctttgagacccgggtcgtctgttccacgcggcggttgcggcgactgttggtggtgtcgcggctgcgggggaaccccgtgggaggcgcctgggaagggctccctaccggccccttcttcccggtcgacgccacgtgggagcacaccgggaaggggtcccgcgggcgcgtctccccctcgccttttgcgatgtcaccgtgaacgctgcggccgcctgcgcgcggcggggtttggaaatacagcgcgtttgcactttgtgata

SEQ ID NO: 148107 - DNA, 730 bp, Homo sapiens
  Payload ID: 9312
  Gene Symbol: LRRC45
  Gene Name: leucine rich repeat containing 45
  ENST ID: ENST00000577638
  CDS Start-End: 713-730
ggcagcccgaggtcgcttcctctccaggctctccaatttctgtgccgtagttaaagcgagcaggggcgccccttcctgcacctgggagtagagggcagttcctctgtatgacgggggagaggccttaacattcgcggtcttacctggttccccgcgtgcagagccggcttggtgcctggcaggggctgcaggtgtttcaaacatgacttcgcagcgagactcttggccagcgccaacccagaccatcgggacagttgtcccttcctgggtctagggagctgccctgaaaaggggcccacggggagggccttggggtcagcaggggcagagagtgaccgccggccccccttacacaggggccacactgctgctccgaggcctgtgtgccaacaccgtgctgcgctttctggacttaaagggcaacaaccttcgggctgcaggggccgaggctctgggaaaactcctccaacagaacaagtccattcagagcctcacgctggagtggaacagcctgggcacgtgggacgatgccttcgccaccttctgcgggggcctggcggccaacggcgccctgcagcggctggacctccgcaacaaccagatcagtcacaagggcgcggaggagctggccctagccctgaagggcaacaccaccctccagcagctggacctgcgctggaataacgttggcctcctggggggccgggccctcatgaactgtctccccagc

SEQ ID NO: 148108 - DNA, 1145 bp, Homo sapiens
  Payload ID: 9312
  Gene Symbol: LRRC45
  Gene Name: leucine rich repeat containing 45
  ENST ID: ENST00000581227
  CDS Start-End: 1-566
agcagttcctcgacttgatggagactattgataagcagcgagaagagatggccaagagcagcagggcgtcggcagcccgtgtagggcagcttcaggaagccctgaatgagaggcactccatcatcaacgctctcaaggccaagctgcagatgacagaggccgccctggctctgtcggagcagaaggcccaggacctgggggagctcctggccacagcggagcaggagcagctgagcctgtcacagaggcaggccaaggagctcaagctggagcagcaggaagctgcagagcgggagtctaaactcctcagagacttgtctgctgccaatgaaaagaacctgcttctgcaaaaccaggtagacgagttggagcggaagttcaggtgtcagcaggagcagctgttccagaccaggcaggagatgaccagcatgtcagctgagctgaagatgcgggccatccaggccgaggagcgcctggacatggagaagagaagatgcagacagagcctggaggactccgaaagcctgcgcatcaaggagggtggggagtccgtgaggagaaggtagggaggcccgctctccactctggccccacaatccctgcccctgagcaggtggagcatatgacccgtcacctggaggagagtgagaaggccatgcaggagcgggtgcagaggctggaggcggcgcggctgtccctggaggaggagctgagccgagtgaaagcagcggcactcagcgagcgtggccaggctgaggaggagctgatcaaggccaagagccaggcccgcctggaggagcaacagcgcctggctcacctggaggacaagctgagactgctggcgcaggcacgggacgaggcgcagggcgcttgcctacagcagaagcaggtggtggccgaggcccagacccgggtcagccagctgggcctgcaagttgagggcctgcggcggcgcctggaagagctgcagcaggagctgagcctcaaggaccaggaaagggtggccgaggtgagcagggtgcgcgtggagctgcaggagcagaacggccggctgcaggcggagctggcggctcaggaggcgctgagggagaaggcggcggccctggagcgccagctgaaagtgatggcgagcgaccaccgagagg

SEQ ID NO: 148109 - DNA, 1922 bp, Homo sapiens
  Payload ID: 9313
  Gene Symbol: LRRC46
  Gene Name: leucine rich repeat containing 46
  Uniprot ID: Q96FV0
  ENST ID: ENST00000269025
  CDS Start-End: 364-1329
gcatgcgctaggccgggccaacggagcccgcctttacctccccactcggcgtccagtctcttagcaacgactccggcttcctaggaactgctcctttctcaaccattcctgcccacaacaccccagcttgctgccagcaaagcccctccacacccctcaaactccagacccttcacatcaatttactgttttcttcgacctcaccccagcaattttctctgaatcaaccccctttcctcctctcctaagtctctgagtttctctctcctcctgccatcctgagttctgccatccttaggggccgccaagacctctcttttcgttcctctcccgcctcagaccagcagccttttattttagatcatgtctggagggaagtcagcccagggtccagaggaagggggcgtctgcatcactgaagcccttatcactaagcggaacttgactttccctgaagatggggaactgtcagagaagatgtttcacactcttgatgaactgcagactgtccgcctggaccgggaggggattactactatcaggaacttagaaggcctccagaatcttcacagtctctatctgcaagggaataagatccagcaaattgagaacctggcttgcatcccctccttgcgcttcctgtctctggcaggaaaccaaatcaggcaggtggaaaacctcctcgacctcccatgcctccagtttctggacctttctgagaacctgatagaaacattgaagctggatgagttcccccagagccttctcatcctcaacctgtctggaaacagctgcaccaaccaggatggctaccgcgagctggtgacagaagccctgccacttctcctggacctggacgggcagcctgtggtggagcgctggatttcggatgaggaggatgaagcctcaagcgatgaggagttcccagagctgagtggcccattctgctcagaacgaggcttcctcaaggagctggagcaggagctgagcaggcacagggagcaccggcaacagacggccctgacagagcacctgctgaggatggagatgcagcccaccctcaccgacctgcccctgctacctggggtgcccatggctggggacagcagcccttctgccactcctgcgcaaggggaggagacagtccctgaggccgtctcctcaccccaggcctcctctcccaccaagaaaccatgcagtctgattcccaggggccaccaaagctctttctggggaaggaagggggcacgagcagccacagcccccaaggcctctgtggctgaggcccccagcacaaccaaaactacggccaagagaagcaagaaatgattctctgtcaacctttctctactagtggagaggagtggggcctgcccctcttctcagacctctgacctgtgacagaagcccatccccagtaaagtgtctctaggccctgagtatgcttttcatgtcacttggggtatctcaggggaagaaaccagtgaaagctccaggaaacaaaatacagagctcagtgagccacctgattctaaagagcgagtctggaatctttcgggagctacccacagggcaggcatgcctcaggcccccgctggcttcctggctcccacttgggcaggaagcgggcaccacctcatggaagaggcatgccatctcactgccacccctagcgagtgcccttccccggtccaagccaaggaccaaggagctgtggtcctagtcatccccaacagcagccagctcctgtcccctccctgtcctcctgcccagtccccatcactcacccactcataggaatgagtacacaaccacaggccccgcagccagcccacagctgcctttgggcctcacttggctctcccacccccactggtcctgggataaagttcactgaagagaaaataaagcacatttattaa

SEQ ID NO: 148110 - DNA, 872 bp, Homo sapiens
  Payload ID: 9313
  Gene Symbol: LRRC46
  Gene Name: leucine rich repeat containing 46
  ENST ID: ENST00000579971
  CDS Start-End: 300-596
caacgactccggcttcctaggaactgctcctttctcaaccattcctgcccacaacaccccagcttgctgccagcaaagcccctccacacccctcaaactccagacccttcacatcaatttactgttttcttcgacctcaccccagcaattttctctgaatcaaccccctttcctcctctcctaagtctctgagtttctctctcctcctgccatcctgagttctgccatccttaggggccgccaagacctctcttttcgttcctctcccgcctcagaccagcagccttttattttagatcatgtctggagggaagtcagcccagggtccagaggaagggggcgtctgcatcactgaagcccttatcactaagcggaacttgactttccctgaagatggggaactgtcagagaagatgtttcacactcttgatgaactgcagactgtccgcctggaccgggaggggattactactatcaggaacttagaaggcctccagaatcttcacagtctctatctgcaagggctccagcccatttcctgttttgaagaagaggaaactatgaagattcctgtacatcattcagatcctacttgaaggctgtttggtggtggtggtggtggttggttgatcttcagccttcccctgaataagatccagcaaattgagaacctggcttgcatcccctccttgcgcttcctgtctctggcaggaaaccaaatcaggcaggtggaaaacctcctcgacctcccatgcctccagtttctggacctttctgagaacctgatagaaacattgaagctggatgagttcccccagagccttctcatcctcaacctgtctggaaacagctgcaccaaccaggatggctac

SEQ ID NO: 148111 - DNA, 2239 bp, Homo sapiens
  Payload ID: 9313
  Gene Symbol: LRRC46
  Gene Name: leucine rich repeat containing 46
  ENST ID: ENST00000584580
  CDS Start-End: 268-411
tctcaaccattcctgcccacaacaccccagcttgctgccagcaaagcccctccacacccctcaaactccagacccttcacatcaatttactgttttcttcgacctcaccccagcaattttctctgaatcaaccccctttcctcctctcctaagtctctgagtttctctctcctcctgccatcctgagttctgccatccttaggggccgccaagacctctcttttcgttcctctcccgcctcagaccagcagccttttattttagatcatgtctggagggaagtcagcccagggtccagaggaagggggcgtctgcatcactgaagcccttatcactaagcggaacttgactttccctgaagatggggaactgtcagagaagatgcactcagcaatgttgtggaatgaatgaatgggtggatggaacaagtgcttttttctccatgaacgactcaaaaggaaggtttcacactcttgatgaactgcagactgtccgcctggaccgggaggggattactactatcaggaacttagaaggcctccagaatcttcacagtctctatctgcaaggggtaacttctttctccacccttcccctccccttgacccctgtggacctaatctgtctcatctgaaaggagccaaccaggtcatcctgcccattccctggtgttcaggcaggcagaccttcatttaaaccattcccagacgaatgacatagggtcctgaattgaaaaactaattccctcaaaatagatcctgaacatgacctgtgctccttccactgttctttaggcacttctcttgatctagaagttctttttggcatctactctaaatctttcacgttaaatagctccagcccatttcctgttttgaagaagaggaaactatgaagattcctgtacatcattcagatcctacttgaaggctgtttggtggtggtggtggtggttggttgatcttcagccttcccctggttgagtattcccagctcgcttcaactttccccatagaaactttaaccgtcaagttcctgtatgctcattgttctctctgtgtatgcaagccaccaccaaggccctttccgttttcctggtggcttcttagtttccttttctgattcccaggtcactctttggttgtggaatcagaagagtatacgtagtcaggtttagataccccaggtttacacccttaaccatccacatggggaaagaaaatcatctttcttaaggtagtggcaacctgttcaaggagtggggtgatcattcccaaagtgccagatctccagctgcagagtagacatggtcttggggctttgtccccgtaaagggcccctgacgcatctgatctcagcttggtttccccacttcggtttcttcttgcagaataagatccagcaaattgagaacctggcttgcatcccctccttgcgcttcctgtctctggcaggaaaccaaatcaggcaggtggaaaacctcctcgacctcccatgcctccagtttctggacctttctgagaacctgatagaaacattgaagctggatgagttcccccagagccttctcatcctcaacctgtctggaaacagctgcaccaaccaggatggctaccgcgagctggtgacagaagccctgccacttctcctggacctggacgggcagcctgtggtggagcgctggatttcggatgaggaggatgaagcctcaagcgatgaggagttcccagagctgagtggcccattctgctcagaacgaggcttcctcaaggagctggagcaggagctgagcaggcacagggagcaccggcaacagacggccctgacagagcacctgctgaggatggagatgcagcccaccctcaccgacctgcccctgctacctggggtgcccatggctggggacagcagcccttctgccactcctgcgcaaggggaggagacagtccctgaggccgtctcctcaccccaggcctcctctcccaccaagaaaccatgcagtctgattcccaggggccaccaaagctctttctggggaaggaagggggcacgagcagccacagcccccaaggcctctgtggctgaggcccccagcacaaccaaaactacggccaagagaagcaagaaatgattctctgtcaacctttctctactagtggagaggagtggggcctgcccctcttctcagacctctgacctgtgacagaagcccatccccagtaaagtgtctctaggccct

SEQ ID NO: 148112 - DNA, 847 bp, Homo sapiens
  Payload ID: 9313
  Gene Symbol: LRRC46
  Gene Name: leucine rich repeat containing 46
  ENST ID: ENST00000579742
  CDS Start-End: 357-500
ctaggccgggccaacggagcccgcctttacctccccactcggcgtccagtctcttagcaacgactccggcttcctaggaactgctcctttctcaaccattcctgcccacaacaccccagcttgctgccagcaaagcccctccacacccctcaaactccagacccttcacatcaatttactgttttcttcgacctcaccccagcaattttctctgaatcaaccccctttcctcctctcctaagtctctgagtttctctctcctcctgccatcctgagttctgccatccttaggggccgccaagacctctcttttcgttcctctcccgcctcagaccagcagccttttattttagatcatgtctggagggaagtcagcccagggtccagaggaagggggcgtctgcatcactgaagcccttatcactaagcggaacttgactttccctgaagatggggaactgtcagagaagatgcactcagcaatgttgtggaatgaatgaatgggtggatggaacaagtgcttttttctccatgaacgactcaaaaggaaggtttcacactcttgatgaactgcagactgtccgcctggaccgggaggggattactactatcaggaacttagaaggcctccagaatcttcacagtctctatctgcaagggaataagatccagcaaattgagaacctggcttgcatcccctccttgcgcttcctgtctctggcaggaaaccaaatcaggcaggtggaaaacctcctcgacctcccatgcctccagtttctggacctttctgagaacctgatagaaacattgaagctggatgagttcccccagagccttctcatcctca

SEQ ID NO: 148113 - DNA, 4310 bp, Homo sapiens
  Payload ID: 9314
  Gene Symbol: LRRC47
  Gene Name: leucine rich repeat containing 47
  Uniprot ID: Q8N1G4
  ENST ID: ENST00000378251
  CDS Start-End: 29-1780
gtgggtgcctgccagcagctgaggcgccatggcggcggcagcggtgtcagagtcttggccggagctggagctggctgagcgcgagcggcggcgggagctgctgctgacggggcccgggctggaggagcgagtgcgggcggcgggtgggcagctgccgccgcggcttttcaccctgccgctgctgcactacttggaagtgagcggctgcgggagcttgcgcgcgccggggcctggcctggcgcagggcctgccgcagctgcacagcctcgtgctgcggcgcaacgcgctggggcccggcctgagccccgagctcgggccgctgcctgcccttcgggtgctcgacctgtcgggcaacgcgctggaggcgctgccgccgggccaaggcctgggccccgccgagccgccgggccttccgcagctgcagagcctcaacctcagcggcaaccggctgcgcgagctgccagccgacctggcgcgctgcgccccgcgcctgcagagcctcaacctcaccggcaattgcctagactcctttcccgccgagctctttcgccccggcgcgctgcccctgctcagtgaactggcggctgctgacaactgcctccgagaactcagccccgacatcgcccacctggcctcgctcaagacgttggacctctcgaacaaccagctgagcgagatccctgcagagcttgcggactgccccaagctcaaggagatcaatttccgtgggaacaagctgagggacaagcgcctggagaagatggtcagcggctgccagaccagatccatcctggagtacctgcgcgtcggaggccgtggtggcgggaagggcaagggccgtgccgagggctcggagaaggaagagagccggaggaagaggagggagaggaagcagaggcgggaaggtggtgatggggaggagcaggacgtgggagatgccggccggctgctgctcagggtcctgcacgtctctgaaaaccccgtacctctgacagtcagagtgagccccgaggtccgggatgtgcggccctacattgtgggggccgtggtgcgaggcatggacctgcagccagggaatgcactcaagcgcttcctcacctcgcagaccaagctccacgaagatctctgtgagaagaggacggctgccacccttgccacccacgagctccgtgccgtcaaagggcccctgctgtactgcgcccggcccccacaggacctcaagattgtccccttggggcggaaagaagccaaggccaaggagctggtgcggcagctgcagctggaggccgaggagcagaggaagcagaagaagcggcagagtgtgtcgggcctgcacagataccttcacttgctggatggaaatgaaaattacccgtgtcttgtggatgcagacggtgatgtgatttccttcccaccaataaccaacagtgagaagacaaaggttaagaaaacgacttctgatttgtttttggaagtaacaagtgccaccagtctgcagatttgcaaggatgtcatggatgccctcattctgaaaatggcagaaatgaaaaagtacactttagaaaataaagaggaaggatcactctcagatactgaagccgatgcagtctctggacaacttccagatcccacaacgaatcccagtgctggaaaggacgggccctcccttctggtggtggagcaggtccgggtggtggatctggaagggagcctgaaggtggtgtacccgtccaaggccgacctggccactgcccctccccacgtgactgtcgtgcgctgacgccagggccgcctgtccgcgtttgtttggccggttttgcggaggtttctatgcggcaatgctgaattatccgttagattttcaccccagtttttttgttggtttttttttttgagatggagtctcgctctgtcgccaggctggagtgcagtggcgtgatctcgagtcactgcagcctgtgtctcctgggttcaagcgattctcctgcctcagcctcccaagtagctgggactacaggtgtgtgccactaagctcagctaatttttgtatttttagtagagacggggtttcaccattttgaccaggatggtcttgatctcttgacctcatgatctgtccacctctgcccctcaaagtgctgggattacgtgatccacccgcctcagcctcccaaagtgctgggattacaggcgtgagctgtgcctggcccaccccagcattttttaagatgtatgtattcgttgttctgtttttccagatgattctgtcgtaaagtgatgctatgttgtcgttacaacatcaaagtgattttacggtttttgatgggattattcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctggtctgggctctcgtcgttggccttgtagatcaagtaggggaagtgagtgatgttcagtcatgctgctgggacacttggttttccagatgaaaacacataaataaaactacatgcaccatcgaggcttgtgtaaagactctgtgatcacacagcagcggctaagcacacgtttctcatgtgtcactgagcgacacgtgactgtcactggttcggagacccgaaaacttgggaagccaaccgatgtgcgtttccttgaacggcacggtcactttctatgacgcagcatcttgtaaaaccatatcatgccaggatgcagcttggcatgtgcaagggcgttgggttctccagctggcagtgatcataatcttggggggaaaagttttaatgtgaccttagaattggcagaattgcgtctcttcatactgctgttggattgctttgtgggggtggagatgtggagaccccttcaggcaagcagcctgtaggctgaaggcagtggcagcacctcaccctggctcagcggggccaagcggaggagagcggcatcggtggggtttccatcgtgtgcacgctggtgctgcagtgacaggcaggtggagccccaggagtggaccagacgcctctgcttgggaagcatcggcagtcctcagccagccgagggacagatggtagcaaaagctggaggatgcttaggtttttgagccaaaaatcttcatttatgcgccagaaaggtgggtcctgggcgccttctgttgtagacgtttccgttgtgaatgtccaggtcagacccccacgtccatgtgtcttcgtgtatgtccaggcaccacatgtgcgtgcacaccactcccgggagtcagtgtgcttggctcatgaggacacggccagccaccgcgatgattttacagaccccactgccttacgatctgggtgccatgtgagaagcagactcatcagctttatcgaatgacaccatttgttctctgttcagtgtctcgatttctgtgtctgtagaaatgactggtgattttgggaagcatctgcaagagccccacagcccacacacctttagttgtcaacctgagaggcccggggccctgtgcagtgggcagactaacagctgggtggctcttcagagccttgcaggacatgggccaggctgccttgagacctggacccacttgtctggtcaccgccaggccttcccgtctcgcccactgtgggagggaggggactccagacaggacgaggcccacacactcagtgccagctggactgccgtgggtgtgtcagatgactgccttgccttgtgtcctcccaaaacctgattcctgctgctctgggcagtcaaggcagatgccacagttggccaggggcctgccctgctggaggcttgaggcggcacgggggcttccccaggccaggactctgctggagttctggggctggggaccccagacagttgctctgagaggtgatttggggctgccatggcagaggctgccctttctctgcatggcccggcccagcccgggaaggaggaagggaggaagggagggatgctggagctgccatcttggctcccggggacttggtgtccatgctgtaacacatctgtcactgcgtgggtgtggatgaggctgccacatgctgtgccctttcctgatgcagcttgtgatgcgtgagatgctggaaatgtatttaactcgcagcacaggtgtctctgatgttttcttcaccccaccccaccccccgactcactaataaaaacagctccgcacctgg

SEQ ID NO: 148114 - DNA, 434 bp, Homo sapiens
  Payload ID: 9314
  Gene Symbol: LRRC47
  Gene Name: leucine rich repeat containing 47
  ENST ID: ENST00000479239
  CDS Start-End: 1-152
ccgaggagcagaggaagcagaagaagcggcagagtgtgtcgggcctgcacaggaaccgcctaatgctaccagaacccagaagcttcttaacagggtacaaagaaagcattctctttccaaaggagacgttgtggaaccagtctgtcatctagatggccctgacgtgagggaagtggaaggtgttaggagcggagataccttcacttgctggatggaaatgaaaattacccgtgtcttgtggatgcagacggtgatgtgatttccttcccaccaataaccaacagtgagaagacaaaggttaagaaaacgacttctgatttgtttttggaagtaacaagtgccaccagtctgcagatttgcaaggatgtcatggatgccctcattctgaaaatggcagaaatgaaaaagtacactttagaaaataaagaggaagg

SEQ ID NO: 148115 - DNA, 2784 bp, Homo sapiens
  Payload ID: 9315
  Gene Symbol: LRRC49
  Gene Name: leucine rich repeat containing 49
  Uniprot ID: Q8IUZ0
  ENST ID: ENST00000260382
  CDS Start-End: 261-2321
aatactcccgctctgtttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaaggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaggaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaa

SEQ ID NO: 148116 - DNA, 3085 bp, Homo sapiens
  Payload ID: 9315
  Gene Symbol: LRRC49
  Gene Name: leucine rich repeat containing 49
  Uniprot ID: Q8IUZ0
  ENST ID: ENST00000443425
  CDS Start-End: 674-2602
aatgggagggctctttgatatcttcctcctcctcctccctgcgctgctccccaggagccagtggacacaagcagagggatacaaatttcgcgcgggcagcgctgaggtgggccgtaaagaggaacggaccggaagtggtggtggttatagcaaccagtgtggccagcctcttccccagcttatcctcctcccaatactcccgctctgtttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaagattttaccaagaatataaagaatgtaaaatgaggtccatcacccaaggagcttgtagatttatttgggaagacaagggctacatatctggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaggaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaataaagtatgtttgcctcctt

SEQ ID NO: 148117 - DNA, 6605 bp, Homo sapiens
  Payload ID: 9315
  Gene Symbol: LRRC49
  Gene Name: leucine rich repeat containing 49
  Uniprot ID: Q8IUZ0
  ENST ID: ENST00000544974
  CDS Start-End: 530-2560
agcaagatgatgcaaacataaaggtctggtgggaaaggctgtgtgaaaatgggaatcccccagggcggaggaagtaaagcagcaagtcctctatccgtctcaaattaccttgaaatcccacctcctggaatcccccatcagcaagtgtccgctgtacctggcctgctaccacctaaagactgagcgcagccagcaggactgggaaaggcagggcgatgatggcagtgaaggatggagtctcactctgtcgcctaggctggagtgccgtggtgcgatctcgctcactgcaacctccacctcccaggttcaagcaattctctgcctcagcatcccgagtagctgggattataggtgcccgccaccatgcccagctcatttttgtatttttagtagaggcggggtttcaccatcttggccaggctggtcttgaattcctgacctcaagtgatccacccgccttggcctcccaaagtgttgggattacaggagtgagccacctcgcccagccaacttgacataacttttaaagatggattgccaagctgaggtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaaggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaggaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaataaagtatgtttgcctccttaattcagtcagaattgtcatatttattgtatgttcctctttagttaggtacggttcctgctattcacctatatggaggatgccccattcttctaggaatgcattctcagggaaccacaggaggtcctgggaatcactatgggcagagaatatgcaaatgagtcaaaactgggataggaagaaaatgttttgtcttaggagatcctgaatgactataaaatgctgttacaaagcagtaaatctgcttctctgaaagatgtttccttccattgttagctctcaaatgctcttttaatagacatgcatgtgtacctgtgtctcagaagtattagggatgcatgagtgaagggttctaatttttaaaatttcatttgaagatcaaattcatgctggtgagaagggtagtaggagcctattaccatagctagagatgatgccacttcagaaaaacaatcttagtcaataaataggaatttttcggtttgcttagattttacctagcagctattatgtcagcaggaccaccaggatatgggaaaacaggactagaagatgtacgacagcaaagacatgcagagacatgcagagacacctggaaggaagctaggtaagctgctattgcggttctgagaaagacccacatccttaagatctcttgattactcttctcccaaaaggcgtgcttaactttaacaggttaccatttttctgatcatagccttaaaaggctgtcctggttttttctttttctttttttttttttgagacagagtcttgctctgtcacccaggctggagtgcagtggcgcgatctcggctcactgcaagctccgcttcccaggttcacgccattctcctgcctcagcctcccaagtagctgggtctacaggtgcccgccaccatgcccagctaagtttttgtatttttagtagagacggggtttcaccatgttagccaggatggtctcgatctcctgacctcatgatccgcctgcctcggcctcccaaagtgctgggattacaggtgtgagccaccatgcctgtcctgtcctggttttttcatcttggcacttaggccatcagcttactagtgtgtaacctcagtttcctcctgatagcacacacttcgtaagatagtcatgagaatcaaaagaaacaatgcatgtaaagcatttctcatcatgcctggcacacagcaaacacccaatacgttgagctttaattattactcttttggctgtaggttgaacaatagggttggtgccctaggacagaggagctattagcattgctttctgatcctttagcctctccaaactgaaacatatggaccatttctcatctggctagtaaacacttatctctcctgggcttatatcttgtttggtatagaaatgagatcccagcttgaaggtgatgttgagaggagaaccaagagtatattgtctgtgggattctggcagattggaaagatgtaagaacttgtgactctttgggagtctgggtaactgttcccactctaggctttgcagatgaatggacctagctgtttagtaatctgtccagcttcctgcatgtctgttctcccctaaccctcccatccctgctgctaaagagacttgacactcacatgctttcttggcccagtcaccctgggaatcttaggaacactaagtcagcactcaatgaaatggcagcaagccatcccagccactgctggctctatgcagacctgcttcaggcctggtaatagggtctctctcttgttcctgaaaccaagcctctttattcctcagctttggtctctgcttccttcctacctgagttccctttcgctcctacctgctcccactaccccatactgatttctacttcttgaatccttactttgtcgggtctcaaacgtcgaatggcgatcctcccatctagttctacactccaaactcattttgcgttctgaagttccttggtgaagataatccccagataaaaagacaaggagacctgggtctgctgggttagggatcaagtgagggtcctatgttgtaagtgagtggtgatctagggaacaaattgccatttcttcttggaattttccagggttttcagggaaggggaagagatgcaaatcccatagtctgagactctctaggctagtgtgtgctgaagaattgctttttttcaaaagggatctcacgcagaaacactattgcatttgcctcaaaagcagaaacatttagtacccccatttagggagatactgtacccgatgttctggtacagcagctggatggtgaagtgtgctgctacacctgaggatggttaccaagtgtgcaggtggacctgaggcttgttaactgtgctgctgagtcagaggatggtgctggtatcagctcctcacttcctgagcttcattccactgaaggcctggcatgtaagacagtgcaaccctaccatgctcctgatctattcctgattgggcaaggaatgcactgggattcatattctcttcaatgagtaatcatcataacaacaaagattcattgagcaatgtcttgcactattataagctctttgtatacattctcatttaatctcctaacactgcgatatatatatgatagcaatcccatttgaacactagaaaactgaggcatagagaggatgaaaaaaaacgtaactaagggtatttcaaccaataaatagtagacagtacccacattcactgttagtcttaaggatctggcatctgggaagaattttgatgtccatggtcgttcctaatccactttcatgttttgtcattatgctgaggaatagcaaataaaagatgagaatttctcaactgtgtctacatgtgaagcatatcgtagacattatgtgcggtataaatactaacaaatgtataagtacacatgtacaatattgtgtattatttaaggatatacatattaaagtgtaaaatattggcagctggattcattgcaataatgtgtagagaatcaacttcaggagggggcaataattaaattagggggaccagttgggaaggtactgcattattctaggcaagagataattgtgacttggatcaaggtgatagcggcagaggcgtcagaaagtagttggatcttgggtatattttaaagatgaagcaacaagatttactgacagaactggatatggagtatgagaaacagtagtcaatgatggccacaaggtttttggcttgaactaccgaaaagattgagttgccatcaactgagatgagagcaatctgtgaatggaacatctgctgggaggaaggatcaggaattccgtcttatggaatacacaatgcatctcaacatgtacaatatatacaagatataccacacatctcagcatatgttgagatggttgttaaatatccaagtgcaggtgttaagtaggtgtgaatatgagttgggagttgagaagtatagattgggctagaattatagaatttggagtcattggcgtatagcagtacttgtttatgctatctttatatttaagagaataaacctatcacttgctaaataag

SEQ ID NO: 148118 - DNA, 1898 bp, Homo sapiens
  Payload ID: 9315
  Gene Symbol: LRRC49
  Gene Name: leucine rich repeat containing 49
  ENST ID: ENST00000560158
  CDS Start-End: 311-1435
tctcctcagtgctttttaccttgcgagtggtgcagcttgttctgcggatgtactgaaaccctcccatttaatctgcagtggaggagagtggagctcactgtccagtagaaatcagtgatgtagcaatgttgcagtaaatagaaatgattatatatttcaatagcttagcaagaagacatttataatatttttttctttcatctgattaagttttgctgtctattttcttccagagagatgtggataatttgccctgcctccaacatctctttctcagctttaacaatatatctaggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaggaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaa

SEQ ID NO: 148119 - DNA, 585 bp, Homo sapiens
  Payload ID: 9315
  Gene Symbol: LRRC49
  Gene Name: leucine rich repeat containing 49
  ENST ID: ENST00000558808
  CDS Start-End: 298-585
agtgctttttaccttgcgagtggtgcagcttgttctgcggatgtactgaaaccctcccatttaatctgcagtggaggagagtggagctcactgtccagtagaaatcagtgatgtagcaatgttgcaagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacaggg

SEQ ID NO: 148120 - DNA, 398 bp, Homo sapiens
  Payload ID: 9315
  Gene Symbol: LRRC49
  Gene Name: leucine rich repeat containing 49
  ENST ID: ENST00000560755
  CDS Start-End: 48-398
gtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaagaactatatgggctggaaatgaaaactgccacgaggtccttatcagcatttggagattcttccattaagacaccttcaaaatccagaatccagcagggctgtcatagtgctggcccaaatatatctggtgatcatattaatttggtgagctcatcattg

SEQ ID NO: 148121 - DNA, 602 bp, Homo sapiens
  Payload ID: 9315
  Gene Symbol: LRRC49
  Gene Name: leucine rich repeat containing 49
  ENST ID: ENST00000558546
  CDS Start-End: 512-602
agcaagtgtccgctgtacctggcctgctaccacctaaagactgagcgcagccagcaggactgggaaaggcagggcgatgatggcagtgaagggtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaaggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcat

SEQ ID NO: 148122 - DNA, 559 bp, Homo sapiens
  Payload ID: 9315
  Gene Symbol: LRRC49
  Gene Name: leucine rich repeat containing 49
  ENST ID: ENST00000558204
  CDS Start-End: 34-222
agatctaacagagaacctggactgtctcctatcatgattcccgggaaatatcgctctgtttctggccgggctgcgaacaacgtgaactgcgggcttcatctggttattcaaacatcatcgcttcctgaaaaaaacaaacatttatacttacctactttctacacactatgtctcaagacacaacatgatttttcctcctttgaccaagttggaaacctctaaccatcacaattcaggtgtgtcctaaaaagttattaaataggcgtcactggaagaactctaaagtgaagggcagagttcacacataacagcatgaagaagggttgaattcaagctaaataaagacacatcgtcattccccggtagacttttacaacatgaccttgaaagaaactactcaagtaggcaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaa

SEQ ID NO: 148123 - DNA, 2586 bp, Homo sapiens
  Payload ID: 9315
  Gene Symbol: LRRC49
  Gene Name: leucine rich repeat containing 49
  Uniprot ID: Q8IUZ0
  ENST ID: ENST00000560369
  CDS Start-End: 270-2345
cctcctcccaatactcccgctctgtttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagtaagatttaagaaggttgaattcaagctaaataaagacacatcgtcattccccggtagacttttacaacatgaccttgaaagaaactactcaagtaggcaaggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaggaaggaaagcaggagaaaggaaggattaattgcctgtatgtgaggaccaaacaacctttgggaactaaacagtttt

SEQ ID NO: 148124 - DNA, 744 bp, Homo sapiens
  Payload ID: 9315
  Gene Symbol: LRRC49
  Gene Name: leucine rich repeat containing 49
  ENST ID: ENST00000559806
  CDS Start-End: 398-744
agtgctttttaccttgcgagtggtgcagcttgttctgcggatgtactgaaaccctcccatttaatctgcagtggaggagagtggagctcactgtccagtagaaatcagtgatgtagcaatgttgcagtaaatagaaatgattatatatttcaatagcttagcaagaagacatttataatatttttttctttcatctgattaagttttgctgtctattttcttccagagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacatacct

SEQ ID NO: 148125 - DNA, 570 bp, Homo sapiens
  Payload ID: 9315
  Gene Symbol: LRRC49
  Gene Name: leucine rich repeat containing 49
  ENST ID: ENST00000559069
  CDS Start-End: 298-570
agtgctttttaccttgcgagtggtgcagcttgttctgcggatgtactgaaaccctcccatttaatctgcagtggaggagagtggagctcactgtccagtagaaatcagtgatgtagcaatgttgcaagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtg

SEQ ID NO: 148126 - DNA, 546 bp, Homo sapiens
  Payload ID: 9315
  Gene Symbol: LRRC49
  Gene Name: leucine rich repeat containing 49
  ENST ID: ENST00000558032
  CDS Start-End: 51-239
agcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaacatttatacttacctactttctacacactatgtctcaagacacaacatgatttttcctcctttgaccaagttggaaacctctaaccatcacaattcaggtgtgtcctaaaaagttattaaataggcgtcactggaagaactctaaagtgaagggcagagttcacacataacagcatgaagaagggttgaattcaagctaaataaagacacatcgtcattccccggtagacttttacaacatgaccttgaaagaaactactcaagtaggcaagattttaccaagaatataaagaatgtaaaatgaggtccatcacccaaggagcttgtagatttatttgggaagacaagggctacatatctggtgatcatattaatttggtgagctcatcat

SEQ ID NO: 148127 - DNA, 3061 bp, Homo sapiens
  Payload ID: 9315
  Gene Symbol: LRRC49
  Gene Name: leucine rich repeat containing 49
  ENST ID: ENST00000561081
  CDS Start-End: 453-677
aatgggagggctctttgatatcttcctcctcctcctccctgcgctgctccccaggagccagtggacacaagcagagggatacaaatttcgcgcgggcagcgctgaggtgggccgtaaagaggaacggaccggaagtggtggtggttatagcaaccagtgtggccagcctcttccccagcttatcctcctcccaatactcccgctctgtttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaagattttaccaagaatataaagaatgtaaaatgaggtccatcacccaaggagcttgtagatttatttgggaagacaagggctacatatctggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaggaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtc

SEQ ID NO: 148128 - DNA, 527 bp, Homo sapiens
  Payload ID: 9315
  Gene Symbol: LRRC49
  Gene Name: leucine rich repeat containing 49
  ENST ID: ENST00000559670
  CDS Start-End: 100-303
aggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaaacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatc

SEQ ID NO: 148129 - DNA, 2721 bp, Homo sapiens
  Payload ID: 9315
  Gene Symbol: LRRC49
  Gene Name: leucine rich repeat containing 49
  ENST ID: ENST00000560107
  CDS Start-End: 301-504
accagtgtggccagcctcttccccagcttatcctcctcccaatactcccgctctgtttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaggaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaa

SEQ ID NO: 148130 - DNA, 580 bp, Homo sapiens
  Payload ID: 9315
  Gene Symbol: LRRC49
  Gene Name: leucine rich repeat containing 49
  ENST ID: ENST00000558456
  CDS Start-End: 346-580
aaaagcatgcttaaagaggctagcggcagcgtctctccctgtctcctcagtgctttttaccttgcgagtggtgcagcttgttctgcggatgtactgaaaccctcccatttaatctgcagtggaggagagtggagctcactgtccagtagaaatcagtgatgtagcaatgttgcaagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcagg

SEQ ID NO: 148131 - DNA, 2531 bp, Homo sapiens
  Payload ID: 9315
  Gene Symbol: LRRC49
  Gene Name: leucine rich repeat containing 49
  ENST ID: ENST00000560691
  CDS Start-End: 1331-2509
ggtgcagccatcacctctatctagttccagaattttttcatcattccaaatggaatccctgtacccattaagcagttacttcccattccctgcttcccttaaatgcctggaagccacaaatatgctttccatctctatggatttgccaatgtggtattttgtgttgaattcaagctaaataaagacacatcgtcattccccggtagacttttacaacatgaccttgaaagaaactactcaagtaggcaagattttaccaagaatataaagaatgtaaaatgaggtccatcacccaaggagcttgtagatttatttgggaagacaagggctacatatctgtggctgaacttacaaagaaagagatgatgcgaggtttacatctgctatccaaaactactttttgtgtatttcctatgcatctcatccacaacaaatgtgacagaactatatgggctggaaatgaaaactgccacgaggtccttatcagcatttggagattcttccattaagacaccttcaaaatccagaatccagcagggctgtcatagtgctggcccaaatatatctggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacaggggaaattggagaagtcacaaaccttattaccattggctctgtgattcctgagcagtaagcaattacaaaaagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttg

SEQ ID NO: 148132 - DNA, 938 bp, Homo sapiens
  Payload ID: 9315
  Gene Symbol: LRRC49
  Gene Name: leucine rich repeat containing 49
  ENST ID: ENST00000559201
  CDS Start-End: 425-613
ctcctcctccctgcgctgctccccaggagccagtggacacaagcagagggatacaaatttcgcgcgggcagcgctgaggtgggccgtaaagaggaacggaccggaagtggtggtggttatagcaaccagtgtggccagcctcttccccagcttatcctcctcccaatactcccgctctgtttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaacatttatacttacctactttctacacactatgtctcaagacacaacatgatttttcctcctttgaccaagttggaaacctctaaccatcacaattcaggttgaattcaagctaaataaagacacatcgtcattccccggtagacttttacaacatgaccttgaaagaaactactcaagtaggcaaggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgtt

SEQ ID NO: 148133 - DNA, 584 bp, Homo sapiens
  Payload ID: 9315
  Gene Symbol: LRRC49
  Gene Name: leucine rich repeat containing 49
  ENST ID: ENST00000557977
  CDS Start-End: 522-584
ttttaactgtgaagagaatttatcattagggactcccacctccttcacctgtctcattgagatgtttatttagacctgaatggcaaatgtcgaaagcctgaggtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaaggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatct

SEQ ID NO: 148134 - DNA, 2958 bp, Homo sapiens
  Payload ID: 9316
  Gene Symbol: LRRC4B
  Gene Name: leucine rich repeat containing 4B
  Uniprot ID: Q9NT99
  ENST ID: ENST00000389201
  CDS Start-End: 138-2279
cccgcagcgggccttgcaccccaaattcctgagcctcattgggggggtcctccccccacgggccgggcatgctgccccccggaaggaacccctctcctcgctccccccagcgtccacgcggagcatgaacattgaggatggcgcgtgcccgcggctccccgtgccccccgctgccgcccggtaggatgtcctggccccacggggcattgctcttcctctggctcttctccccacccctgggggccggtggaggtggagtggccgtgacgtctgccgccggagggggctccccgccggccacctcctgccccgtggcctgctcctgcagcaaccaggccagccgggtgatctgcacacggagagacctggccgaggtcccagccagcatcccggtcaacacgcggtacctgaacctgcaagagaacggcatccaggtgatccggacggacacgttcaagcacctgcggcacctggagattctgcagctgagcaagaacctggtgcgcaagatcgaggtgggcgccttcaacgggctgcccagcctcaacacgctggagctttttgacaaccggctgaccacggtgcccacgcaggccttcgagtacctgtccaagctgcgggagctctggctgcggaacaaccccatcgagagcatcccctcctacgccttcaaccgcgtgccctcgctgcggcgcctggacctgggcgagctcaagcggctggaatacatctcggaggcggccttcgaggggctggtcaacctgcgctacctcaacctgggcatgtgcaacctcaaggacatccccaacctgacggccctggtgcgcctggaggagctggagctgtcgggcaaccggctggacctgatccgcccgggctccttccagggtctcaccagcctgcgcaagctgtggctcatgcacgcccaggtagccaccatcgagcgcaacgccttcgacgacctcaagtcgctggaggagctcaacctgtcccacaacaacctgatgtcgctgccccacgacctcttcacgcccctgcaccgcctcgagcgcgtgcacctcaaccacaacccctggcattgcaactgcgacgtgctctggctgagctggtggctcaaggagacggtgcccagcaacacgacgtgctgcgcccgctgtcatgcgcccgccggcctcaaggggcgctacattggggagctggaccagtcgcatttcacctgctatgcgcccgtcatcgtggagccgcccacggacctcaacgtcaccgagggcatggctgccgagctcaaatgccgcacgggcacctccatgacctccgtcaactggctgacgcccaacggcaccctcatgacccacggctcctaccgcgtgcgcatctccgtcctgcatgacggcacgcttaacttcaccaacgtcaccgtgcaggacacgggccagtacacgtgcatggtgacgaactcagccggcaacaccaccgcctcggccacgctcaacgtctcggccgtggaccccgtggcggccgggggcaccggcagcggcgggggcggccctgggggcagtggtggtgttggagggggcagtggcggctacacctacttcaccacggtgaccgtggagaccctggagacgcagcccggagaggaggccctgcagccgcgggggacggagaaggaaccgccagggcccacgacagacggtgtctggggtgggggccggcctggggacgcggccggccctgcctcgtcttctaccacggcacccgccccgcgctcctcgcggcccacggagaaggcgttcacggtgcccatcacggatgtgacggagaacgccctcaaggacctggacgacgtcatgaagaccaccaaaatcatcatcggctgcttcgtggccatcacgttcatggccgcggtgatgctcgtggccttctacaagctgcgcaagcagcaccagctccacaagcaccacgggcccacgcgcaccgtggagatcatcaacgtggaggacgagctgcccgccgcctcggccgtgtccgtggccgccgcggccgccgtggccagtgggggtggtgtgggcggggacagccacctggccctgcccgccctggagcgagaccacctcaaccaccaccactacgtggctgccgccttcaaggcgcactacagcagcaaccccagcggcgggggctgcgggggcaaaggcccgcctggcctcaactccatccacgaacctctgctcttcaagagcggctccaaggagaacgtgcaagagacgcagatctgaggcggcggggccgggcgggcgaggggcgtggagccccccacccaggtcccagcccgggcgcagcctgaccgggacccctccctcccacagcccagcccaccttctgggaccacgcagggaattggggagaggtggcttccagccccatctggggctcggacccccagtaaggacagggtggggctccaggagcggagtctctgggatcctcgcctcacccccgccaatccccggtgacgggaggggacgtgggacccaggagaagtggcctgagttctccgcgtttcctcctcgctctcccaccaagcgttccgggcccgccgccttccaggggagagaggagctttctccaggggtgtcctttcccctcggccccaaacaccttccttttacggttcagtttttgcagtttgacgcccgtccctccctcccactcctccgccctcaaaactgaagagatggacacgtcgccagagctcccgtcccagcgcccggctctgctcccggccggcggtccctgtcgtcggcgcgggggggagcctccacccgccccagccccacctgccccacagacacttttgatactgaagggaggtttgcgtcaacgactacctgctctgtaattactttaaaaaaaaaacatggaaaaagtaaaaaaatattttttttggtcatgaaa

SEQ ID NO: 148135 - DNA, 3019 bp, Homo sapiens
  Payload ID: 9316
  Gene Symbol: LRRC4B
  Gene Name: leucine rich repeat containing 4B
  Uniprot ID: Q9NT99
  ENST ID: ENST00000599957
  CDS Start-End: 199-2340
atgcggaggtagacatggcagcggcaggcctggaggccggggtgggtgccgtgggctcccacaggccctgcggggtcccccggcctcaaatccaggccctgcgctttgggccagccctttggctaagagggtgtgggctggatcatcgccagggtcttaagagccccccagcgtccacgcggagcatgaacattgaggatggcgcgtgcccgcggctccccgtgccccccgctgccgcccggtaggatgtcctggccccacggggcattgctcttcctctggctcttctccccacccctgggggccggtggaggtggagtggccgtgacgtctgccgccggagggggctccccgccggccacctcctgccccgtggcctgctcctgcagcaaccaggccagccgggtgatctgcacacggagagacctggccgaggtcccagccagcatcccggtcaacacgcggtacctgaacctgcaagagaacggcatccaggtgatccggacggacacgttcaagcacctgcggcacctggagattctgcagctgagcaagaacctggtgcgcaagatcgaggtgggcgccttcaacgggctgcccagcctcaacacgctggagctttttgacaaccggctgaccacggtgcccacgcaggccttcgagtacctgtccaagctgcgggagctctggctgcggaacaaccccatcgagagcatcccctcctacgccttcaaccgcgtgccctcgctgcggcgcctggacctgggcgagctcaagcggctggaatacatctcggaggcggccttcgaggggctggtcaacctgcgctacctcaacctgggcatgtgcaacctcaaggacatccccaacctgacggccctggtgcgcctggaggagctggagctgtcgggcaaccggctggacctgatccgcccgggctccttccagggtctcaccagcctgcgcaagctgtggctcatgcacgcccaggtagccaccatcgagcgcaacgccttcgacgacctcaagtcgctggaggagctcaacctgtcccacaacaacctgatgtcgctgccccacgacctcttcacgcccctgcaccgcctcgagcgcgtgcacctcaaccacaacccctggcattgcaactgcgacgtgctctggctgagctggtggctcaaggagacggtgcccagcaacacgacgtgctgcgcccgctgtcatgcgcccgccggcctcaaggggcgctacattggggagctggaccagtcgcatttcacctgctatgcgcccgtcatcgtggagccgcccacggacctcaacgtcaccgagggcatggctgccgagctcaaatgccgcacgggcacctccatgacctccgtcaactggctgacgcccaacggcaccctcatgacccacggctcctaccgcgtgcgcatctccgtcctgcatgacggcacgcttaacttcaccaacgtcaccgtgcaggacacgggccagtacacgtgcatggtgacgaactcagccggcaacaccaccgcctcggccacgctcaacgtctcggccgtggaccccgtggcggccgggggcaccggcagcggcgggggcggccctgggggcagtggtggtgttggagggggcagtggcggctacacctacttcaccacggtgaccgtggagaccctggagacgcagcccggagaggaggccctgcagccgcgggggacggagaaggaaccgccagggcccacgacagacggtgtctggggtgggggccggcctggggacgcggccggccctgcctcgtcttctaccacggcacccgccccgcgctcctcgcggcccacggagaaggcgttcacggtgcccatcacggatgtgacggagaacgccctcaaggacctggacgacgtcatgaagaccaccaaaatcatcatcggctgcttcgtggccatcacgttcatggccgcggtgatgctcgtggccttctacaagctgcgcaagcagcaccagctccacaagcaccacgggcccacgcgcaccgtggagatcatcaacgtggaggacgagctgcccgccgcctcggccgtgtccgtggccgccgcggccgccgtggccagtgggggtggtgtgggcggggacagccacctggccctgcccgccctggagcgagaccacctcaaccaccaccactacgtggctgccgccttcaaggcgcactacagcagcaaccccagcggcgggggctgcgggggcaaaggcccgcctggcctcaactccatccacgaacctctgctcttcaagagcggctccaaggagaacgtgcaagagacgcagatctgaggcggcggggccgggcgggcgaggggcgtggagccccccacccaggtcccagcccgggcgcagcctgaccgggacccctccctcccacagcccagcccaccttctgggaccacgcagggaattggggagaggtggcttccagccccatctggggctcggacccccagtaaggacagggtggggctccaggagcggagtctctgggatcctcgcctcacccccgccaatccccggtgacgggaggggacgtgggacccaggagaagtggcctgagttctccgcgtttcctcctcgctctcccaccaagcgttccgggcccgccgccttccaggggagagaggagctttctccaggggtgtcctttcccctcggccccaaacaccttccttttacggttcagtttttgcagtttgacgcccgtccctccctcccactcctccgccctcaaaactgaagagatggacacgtcgccagagctcccgtcccagcgcccggctctgctcccggccggcggtccctgtcgtcggcgcgggggggagcctccacccgccccagccccacctgccccacagacacttttgatactgaagggaggtttgcgtcaacgactacctgctctgtaattactttaaaaaaaaaacatggaaaaagtaaaaaaatattttttttggtcatgaaa

SEQ ID NO: 148136 - DNA, 853 bp, Homo sapiens
  Payload ID: 9316
  Gene Symbol: LRRC4B
  Gene Name: leucine rich repeat containing 4B
  ENST ID: ENST00000600381
  CDS Start-End: 138-853
cccgcagcgggccttgcaccccaaattcctgagcctcattgggggggtcctccccccacgggccgggcatgctgccccccggaaggaacccctctcctcgctccccccagcgtccacgcggagcatgaacattgaggatggcgcgtgcccgcggctccccgtgccccccgctgccgcccggtaggatgtcctggccccacggggcattgctcttcctctggctcttctccccacccctgggggccggtggaggtggagtggccgtgacgtctgccgccggagggggctccccgccggccacctcctgccccgtggcctgctcctgcagcaaccaggccagccgggtgatctgcacacggagagacctggccgaggtcccagccagcatcccggtcaacacgcggtacctgaacctgcaagagaacggcatccaggtgatccggacggacacgttcaagcacctgcggcacctggagattctgcagctgagcaagaacctggtgcgcaagatcgaggtgggcgccttcaacgggctgcccagcctcaacacgctggagctttttgacaaccggctgaccacggtgcccacgcaggccttcgagtacctgtccaagctgcgggagctctggctgcggaacaaccccatcgagagcatcccctcctacgccttcaaccgcgtgccctcgctgcggcgcctggacctgggcgagctcaagcggctggaatacatctcggaggcggccttcgaggggctggtcaacctgcgctacctcaacctgggcatgtgcaacctcaaggacatccccaacctgacggccctggtgcgcctggaggagctggagctgtcgggcaa

SEQ ID NO: 148137 - DNA, 4054 bp, Homo sapiens
  Payload ID: 9317
  Gene Symbol: LRRC4C
  Gene Name: leucine rich repeat containing 4C
  Uniprot ID: Q9HCJ2
  ENST ID: ENST00000278198
  CDS Start-End: 1965-3887
aagaaagaggggcagaggagggaaggcgactgcagtccgaaaggagcttttggaagctaggaccctaagcgtcaggacgtggcattggtcgagagaaagcctgggctggcaagagctgccgccggtgctgggagagcatttatttgggagaaaaagaggggagagagcagagggagggggaggaagagagttcaaaccgaagtggatggaaggggactggggtttctgccgcgcagggagccgtgagccagggcgatggcgctaagggcggcgcggagcagctgcgctcccgagaacgcgtctcctcgcagaggactagcagacatcgggaaggtctgcgccaacgggaaccaacttgtggctccaaaatgtacccaacgcagctggaaatgagatcaaagctgcagttgcatttgagaaggatgagaagagccagcgattagggaattttttttttacccgttttcttcctttttctttttttcttctttttctttttttctttcttttttcgtgtgtgttttttttaatttgcctaccaccctgtctgtcccctcacttcgccctccccatttgaaataaaagccccagtctcaacttccatcacctcggcgctcccggagccactaccggctgatggaggagaaggggacccgggggctggcaggggccaccggcgagggaccgcatcctgcgtctcccccgtgatcccggccccgaccgcggagttctgcaacacctggaggatctggaccgggtgctgggggtgggggcggggacagaggaaggaaaggcaccccgagccttaaaaagaaaaaaaaaaagtagcggggggaggaatgggtttcttcttgacagctgacggagccttgaaattttcctccactacctccgcccccgcccccgcccccgccccccgcactccatttaacgtgagattatgaaattgcagaggcggtggagggaaggagacaggatataaccggagtttggaggggagaggggaaggtggctggccgggtggctgaaatcaaaaattcaattgcgcactgggttgtgatgagaaatctaatcagatctttggcgaaggggccggccggaaggatggagagtgggggggaagttgctccccaaattcttcgaaggggaggctggggagaggaattgaccatgtaaaaggagacttttttttttggtggtggtggctgttgggtgccttgcaaaaatgaaggatgcaggacgcagctttctcctggaaccgaacgcaatggataaactgattgtgcaagagagaaggaagaacgaagctttttcttgtgagccctggatcttaacacaaatgtgtatatgtgcacacagggagcattcaagaatgaaataaaccagagttagacccgcgggggttggtgtgttctgacataaataaataatcttaaagcagctgttcccctccccccccccaaaaaaaaggatgattggaaatgaagaaccgaggattcacaaagaaaaaagtatgttcatttttctctataaaggagaaagtgagccaaggagatatttttggaatgaaaagtttggggcttttttagtaaagtaaagaactggtgtggtggtgttttcttttctttttgaatttcccacaagaggagaggaaattaataatacatctgcaaagaaatttcagagaagaaaagttgaccgcggcagattgaggcattgattgggggagagaaaccagcagagcacagttggatttgtgcctatgttgactaaaattgacggataattgcagttggatttttcttcatcaacctcctttttttttaatttttattccttttggtatcaagatcatgcgttttctcttgttcttaaccacctggatttccatctggatgttgctgtgatcagtctgaaatacaactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgagacacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggctaaatctactgtttcaaaaaagtgtctttacaaaaaaacaaaaaagaaaagaaatttatttattaaaaattctattgtgatctaaagcagac

SEQ ID NO: 148138 - DNA, 583 bp, Homo sapiens
  Payload ID: 9317
  Gene Symbol: LRRC4C
  Gene Name: leucine rich repeat containing 4C
  ENST ID: ENST00000533474
  CDS Start-End: 461-583
acttctcaggcaaagagcatgccaacagcctttctcttctgctttgcttgtctgtggtggatactagcaacctatgtggttctaaagtatcaagctgagattatagtatcaatgagttggaacatcaatagtgccaagtgccatttaaaaatcttttcatcttcttgtgtgttgcttttggagaggaaatgttttcagatgtggtttctagccttgcagaaaaatggcattttcaggctgtatgggactcttacatcatctagtttcaatcacctcattttgcagagcaagaaactgagagtgagaaagaagggactggccagagttactcagctagacagtgacagacaacagtggaacttctgattggcaaacgcactgcctacttacagcatagagacccccagtggagagctagactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctg

SEQ ID NO: 148139 - DNA, 2669 bp, Homo sapiens
  Payload ID: 9317
  Gene Symbol: LRRC4C
  Gene Name: leucine rich repeat containing 4C
  Uniprot ID: Q9HCJ2
  ENST ID: ENST00000530763
  CDS Start-End: 670-2592
ggtatttcgtacagtaggagatttcaacaacgtgacaatattctctaggcacttgggctcactgtctgtagcccccaccccccgcctttcgccacctccttgcttccctactcccccttctgcttttgcctttgatgagtttttggcttactttttggcggagtctcttggacacgtttttgctggtgctggaagatcagatacatggaacctttgaaaactgattatttttctccgatatgacttaaaaaaaaataaaaagaagaaaagaaaatagagtagtgcacggcaagctagaggattgtaaattttccttggtgaactttgaggatccataaagaaggagttactggaaaagcaagaataacttatgcggattaacaatatggaaacatcctgagactactttggaatcgccataaattaagtgggttccagttttgcaaacagagaaacgggtccatgaacaatttgctacaggtataaagaagtatctgcagaaatccagagcacttattaaacttctttgagttttctcaggaagatcaatacctgttggagaaattttactaagattggcaaacgcactgcctacttacagcatagagacccccagtggagagctagactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgagacacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggcta

SEQ ID NO: 148140 - DNA, 3085 bp, Homo sapiens
  Payload ID: 9317
  Gene Symbol: LRRC4C
  Gene Name: leucine rich repeat containing 4C
  Uniprot ID: Q9HCJ2
  ENST ID: ENST00000527150
  CDS Start-End: 1034-2956
ggagtttggaggggagaggggaaggtggctggccgggtggctgaaatcaaaaattcaattgcgcactgggttgtgatgagaaatctaatcagatctttggcgaaggggccggccggaaggatggagagtgggggggaagttgctccccaaattcttcgaaggggaggctggggagaggaattgaccatgtaaaaggagacttttttttttggtggtggtggctgttgggtgccttgcaaaaatgaaggatgcaggacgcagctttctcctggaaccgaacgcaatggataaactgattgtgcaagagagaaggaagaacgaagctttttcttgtgagccctggatcttaacacaaatgtgtatatgtgcacacagggagcattcaagaatgaaataaaccagagttagacccgcgggggttggtgtgttctgacataaataaataatcttaaagcagctgttcccctccccccccccaaaaaaaaggatgattggaaatgaagaaccgaggattcacaaagaaaaaagtatgttcatttttctctataaaggagaaagtgagccaaggagatatttttggaatgaaaagtttggggcttttttagtaaagtaaagaactggtgtggtggtgttttcttttctttttgaatttcccacaagaggagaggaaattaataatacatctgcaaagaaatttcagagaagaaaagttgaccgcggcagattgaggcattgattgggggagagaaaccagcagagcacagttggatttgtgcctatgttgactaaaattgacggataattgcagttggatttttcttcatcaacctcctttttttttaatttttattccttttggtatcaagatcatgcgttttctcttgttcttaaccacctggatttccatctggatgttgctgtgatcagtctgaaatacaattggcaaacgcactgcctacttacagcatagagacccccagtggagagctagactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgagacacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggctaaatctactgtttcaaaaaagtgtctttacaaaaaaacaaaaaagaaaagaaa

SEQ ID NO: 148141 - DNA, 2650 bp, Homo sapiens
  Payload ID: 9317
  Gene Symbol: LRRC4C
  Gene Name: leucine rich repeat containing 4C
  Uniprot ID: Q9HCJ2
  ENST ID: ENST00000528697
  CDS Start-End: 651-2573
ctggaagatcagatacatggaacctttgaaaactgattatttttctccgatatgacttaaaaaaaaataaaaagaagaaaagaaaatagagtagtgcacggcaagctagaggattgtaaattttccttggtgaactttgaggatccataaagaagaaatggttctctttactgcgaggctgcaaggtcacccaatgagagaggggccaaataagctggaacatcatctaatacactgaatgtaggagttactggaaaagcaagaataacttatgcggattaacaatatggaaacatcctgagactactttggaatcgccataaattaagtgggttccagttttgcaaacagagaaacgggtccatgaacaatttgctacaggtataaagaagtatctgcagaaatccagagcacttattaaacttctttgagttttctcaggaagatcaatacctgttggagaaattttactaagagcaagaaactgagagtgagaaagaagggactggccagagttactcagctagacagtgacagacaacagtggaacttctgattggcaaacgcactgcctacttacagcatagagacccccagtggagagctagactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgagacacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggcta

SEQ ID NO: 148142 - DNA, 2286 bp, Homo sapiens
  Payload ID: 9317
  Gene Symbol: LRRC4C
  Gene Name: leucine rich repeat containing 4C
  Uniprot ID: Q9HCJ2
  ENST ID: ENST00000619527
  CDS Start-End: 199-2121
ttcctgcaggtataaagaagtatctgcagaaatccagagcacttattaaacttctttgagttttctcaggaagatcaatacctgttggagaaattttactaagattggcaaacgcactgcctacttacagcatagagacccccagtggagagctagactgtttgaattccagaaggaccaacaccagataaattatgaatgttgaacaagatgaccttacatccacagcagataatgataggtcctaggtttaacagggccctatttgaccccctgcttgtggtgctgctggctcttcaacttcttgtggtggctggtctggtgcgggctcagacctgcccttctgtgtgctcctgcagcaaccagttcagcaaggtgatttgtgttcggaaaaacctgcgtgaggttccggatggcatctccaccaacacacggctgctgaacctccatgagaaccaaatccagatcatcaaagtgaacagcttcaagcacttgagacacttggaaatcctacagttgagtaggaaccatatcagaaccattgaaattggggctttcaatggtctggcgaacctcaacactctggaactctttgacaatcgtcttactaccatcccgaatggagcttttgtatacttgtctaaactgaaggagctctggttgcgaaacaaccccattgaaagcatcccttcttatgcttttaacagaattccttctttgcgccgactagacttaggggaattgaaaagactttcatacatctcagaaggtgcctttgaaggtctgtccaacttgaggtatttgaaccttgccatgtgcaaccttcgggaaatccctaacctcacaccgctcataaaactagatgagctggatctttctgggaatcatttatctgccatcaggcctggctctttccagggtttgatgcaccttcaaaaactgtggatgatacagtcccagattcaagtgattgaacggaatgcctttgacaaccttcagtcactagtggagatcaacctggcacacaataatctaacattactgcctcatgacctcttcactcccttgcatcatctagagcggatacatttacatcacaacccttggaactgtaactgtgacatactgtggctcagctggtggataaaagacatggccccctcgaacacagcttgttgtgcccggtgtaacactcctcccaatctaaaggggaggtacattggagagctcgaccagaattacttcacatgctatgctccggtgattgtggagccccctgcagacctcaatgtcactgaaggcatggcagctgagctgaaatgtcgggcctccacatccctgacatctgtatcttggattactccaaatggaacagtcatgacacatggggcgtacaaagtgcggatagctgtgctcagtgatggtacgttaaatttcacaaatgtaactgtgcaagatacaggcatgtacacatgtatggtgagtaattccgttgggaatactactgcttcagccaccctgaatgttactgcagcaaccactactcctttctcttacttttcaaccgtcacagtagagactatggaaccgtctcaggatgaggcacggaccacagataacaatgtgggtcccactccagtggtcgactgggagaccaccaatgtgaccacctctctcacaccacagagcacaaggtcgacagagaaaaccttcaccatcccagtgactgatataaacagtgggatcccaggaattgatgaggtcatgaagactaccaaaatcatcattgggtgttttgtggccatcacactcatggctgcagtgatgctggtcattttctacaagatgaggaagcagcaccatcggcaaaaccatcacgccccaacaaggactgttgaaattattaatgtggatgatgagattacgggagacacacccatggaaagccacctgcccatgcctgctatcgagcatgagcacctaaatcactataactcatacaaatctcccttcaaccacacaacaacagttaacacaataaattcaatacacagttcagtgcatgaaccgttattgatccgaatgaactctaaagacaatgtacaagagactcaaatctaaaacatttacagagttacaaaaaacaaacaatcaaaaaaaaagacagtttattaaaaatgacacaaatgactgggctaaatctactgtttcaaaaaagtgtctttacaaaaaaacaaaaaagaaaagaaatttatttattaaaaattctattgtgatctaaagcag

SEQ ID NO: 148143 - DNA, 1369 bp, Homo sapiens
  Payload ID: 9318
  Gene Symbol: LRRC52
  Gene Name: leucine rich repeat containing 52
  Uniprot ID: Q8N7C0
  ENST ID: ENST00000294818
  CDS Start-End: 291-1232
acttgcaaacgcagggaaagggtgagacctttcaaagctgccaagtgggcaagcttccagcagcagtctgggagcgagcgacagagccaccaagctgggcggcagggcattgagcctcgcgtttcaatttctgttcagttctcctgtaatggaaaattgctttgcacaaagctaaagtgttacagttctttccagagcccctcccccgccccacccccccaccggcagccttcggatcagaggacagagcccgcaggaaggtgaaaggagggtggttgtggcttcttactatgtcccttgcttcaggccctggccctgggtggttactcttttcctttggaatggggctggtatcagggtcaaagtgtccaaataattgtctgtgtcaagcccaagaagtaatctgcacagggaagcagttaaccgaatacccccttgacatacccctgaacacccggaggctgttcctgaacgagaacagaatcactagtttgccagcaatgcatctaggactcctcagtgaccttgtttatttggactgtcagaacaaccggattcgagaggtgatggattataccttcatcggggtcttcaaactcatctaccttgacctcagctccaacaacctaacctcgatctccccattcactttctcggtgctcagcaacctggtgcagctgaacattgccaacaaccctcacctgttatcgcttcacaagttcacctttgccaacaccacctctttgaggtacctggacctcagaaataccggcttgcagaccctggacagtgctgccttataccacctcactactctggagaccctgtttctgagtggaaacccctggaagtgcaactgctctttcctggacttcgccatcttcttaatagtgttccatatggacccctcagatgatctaaatgccacatgtgtggagcccacagagctgacagggtggcccatcacccgggtggggaacccactccgatacatgtgcatcacgcacctggaccacaaagactacatcttcctgctgctcatcggcttctgcatcttcgccgcgggaactgtggctgcctggctcacaggtgtgtgtgctgtgctctaccagaacacccgccacaagtcgagtgaagaagatgaggacgaggccgggactagggtggaagtcagccggcggatttttcaaacccagacgagctcggtccaggagttccctcagcttatttagttgccagagaccactatcttatgtgcctcccccaggctccctgctttctctcttgccctccccatcccaccaccttggagctgtcatagagattgaaaccttctagtaaaataaataaaatctctgatggccatttc

SEQ ID NO: 148144 - DNA, 3859 bp, Homo sapiens
  Payload ID: 9319
  Gene Symbol: LRRC53
  Gene Name: leucine rich repeat containing 53
  Uniprot ID: A6NM62
  ENST ID: ENST00000294635
  CDS Start-End: 116-3859
gatgctggacagttaactcagtaggtctcagattcatcatccaccttttaatgtagagattcacaaactacaagctgtgagacctttgggtggatggctggtactctttgccatcatgttgcggttggtggcagcttgccctgagtcatgtgtggtgtgcaccaaagatgtaaccctctgtcaccagctaacctatatagtagcagcccctatgaccacgagggttttaatcatcaccgatggatatctctcctctattgagagcacaaacctgtctctcttgtttaatcttgccctgctctccctaagcagaaatggtatcgaggatgttcaggaagatgccctgcatgggcttacgatgttgcggaccttgttgctggagcacaaccaaatatccagctcttcgctcactgatcacaccttcagcaagcttcacagcctgcaggtactggtgctgagcaataatgctctccgcaccctacgagggtcttggttccgaaacacaagcggcctgacccggctccagctggatgggaatcagattactaatctcacagacagttctttcggaggcacgaatctccacagtctcaggtatctggatttatccaacaattttatttcctacattgggaaagatgccttccggcccctgcctcaactacaggaagtggacctttcccgaaataggttagcccacatgccggatgtgtttactccactgaagcagttaatccttctgagcttagataagaaccagtggagctgcacttgtgatctccatccccttgctcggtttttaagaaactacattaagtcttctgctcacacgctcaggaatgccaaggacctaaattgccagccatctaccgcagctgtggcagctgcacagagtgtgctgaggctgtctgagaccaactgtgattccaaagctcccaacttcactctggttctaaaggacagaagtcccctcctcccaggaccagatgtggccctgctgactgtccttggcttcgcaggagctgttggtctcacttgcctaggtttagttgtatttaactggaaactccaccaaggcaaagcaaatgaacacacatcagaaaacctttgttgcagaaccttcgatgaacccctgtgtgctcatgaggcaagaaattaccacactaagggatactgcaactgccacttaactcaggaaaacgagataaaggtcatgtccactgtggggtccagaaaagaaatgccacttttacaggaaaatagccatcaagcaacatcggcctctgagtctgcaacccttgacggatcatttagaaacctgaaaaagaaagaccgtggggtaggcagcactttattttgccaggatggtagattgctgcattcggaatgttcagagcctcctggaaatatgagagcttttaatgaagcaggcttacttacaacatataatccaaggaaagttcaaaagctatggaatcttgagcctggagaagtccagcctcaaactctgcaacaccatataataagaacagaagatatcagcagtgacatatttagaagaagatatgcaacacccgcttcagccttggcaggagaaagtcttgagaagcgtttaacaaatgaatcatggcagcctccaatagaaaaagaagacaatggcttacaccctcataggcaaagacattttattacaagctcatcatccaagccttgtgagcctgaggaacactatgtacaaaagatcgtacaaaaaaatagatcaaaatatgatgatccttgtggactgttaaaacagagcaaacctaggtattttcagccaaacaattctcttatctgtaaatatgtgccctgtgagcaatttgaagattacatgaaagaaaagaagccaaatcgtagacaacactcaaagcctgagaaagagcaaatccaaattaacagtgcaatagaaaaatttcttatgagtgaggacaacatagatttatcaggattatcaacaaaaaccaagaaagcatattccccaaagagggttatcttccatgatcctgatttagtagaaataaataggtcgatgatgtcacccaaaatatcaaccccttggaaacgacagaaaaatcaaagtaaccaactgactaagttggatgttaaaaaatttagcaacactggggagagaaacaaaggagaaaaatggtttactaattcatgggttctgaaaaggaagagaacccctcagtctgacctcaaagggaaaattaaaggacaaaacttaaaattaaatttacatccttttagaaaagtcagagtccatccagaaaaatccttgtcaagtctcccaaagcaatgcaagcaggtattgttgcctcctaagaaattatccaaaacttctgagacagaagccaaaataaatactgtgtgttctgcagattttcttcaacagtcagagagtagcaactatgttagactcacttcaaagaggctgcctctgaaacatgactcaaagcagaccccatattatcaacgaaacactaaacgtgcccccctgctcagtgctaacaacttgcgtgtagtcaaccagagctctatagaaagcagctgttactcagctggccacattcctgatggaaacacatcaaaattgccccaacctacacccactgatgctgagcacaggcactcacattctcaattctcaactgagcaaatggaagatgcaactcagcttgaatcaaaagtgcttagttatttagcaactacttgggaaaatacaggaagtgatgttttaccattccaacattccaggagggctactgaccaagggacaacggagtccactgagcacatgggacagaatgtatcaaagaccagtgagttaaatcagttttctttgtccccgaggaatcaaacacaacttttagatgctcacaagactgacagctacaacaaggaatacactttagaccaaaatgaagccttacaacacagagagcaaaattcaagtcatgcacagcttgaaaataaagaaaaaacattaatgacaaaaccccaaatatcacatcaaattgtggaaaattgtattatggataaggaagaaaatgatgtagaaaaaaaactttcaaaaacagaaacttatgattcctctctcattccccaaacacaatccaagaacaacctatcatttatgaagacaaattcaattccataccaaaatagaatagaacttcccaaggatatcagtacttctcctgttagtagtcaagccgtttggcacctaaccaatagtagcgaaaaaggaattgacagcacaaatgcattgcccagaaatgacggcactgaagcactagagataaaaatagtagggaaagaagagaaaaatatgcttgatgaaagcaagacagattctagtatgttaactcagatctcacaaatgaccttaaaaggcatcacaaaagaaaggcagcaaacttgggaaaatggaacaagtgaaaaatatatattacatgatgcaagctctgccgaggagaccattacagctaaagatttaagtatcacaagttcccatgaaacccaaaatagaatactttgcagtgaagtagatcctgaagttaacagtaatgtacataattttagagaagttcaaaatattcaaccagataaagatagtgcacataaagaaggcgcaatgacagtggagacacatgaagcgctttccttcttaccagggttaaaagacagttttgaggcagaaaatgaggtgtttttagttcctagcagaataaatgaagctgaaaactctgctccaaaacctgtactgtatccaccatctgctgaatatgctactacatcacctttagaaacagaataa

SEQ ID NO: 148145 - DNA, 5410 bp, Homo sapiens
  Payload ID: 9320
  Gene Symbol: LRRC55
  Gene Name: leucine rich repeat containing 55
  Uniprot ID: Q6ZSA7
  ENST ID: ENST00000497933
  CDS Start-End: 148-1173
ttctcaggttttgatcatcattccagaccctaggggacctcaactgggtgtcttgccccctaggctccggaaggggacctcccgtggatctcaggaagccctctggtgctcagaggctcctgggaaagtccctagccatgataccacatgctcagaagccccaccttcacagacgctggccccagatgtagctgccttcctgtgtcacagactctcgattccatggacacagtcctcatgggctccctccagcactgctgttgcctgctgcctaagatgggtgacacttgggcccagcttccctggcccgggccaccccacccagcaatgctgctgatctccctcctcttggcagccgggttgatgcactcggatgccggcaccagctgccccgtcctttgcacatgccgtaaccaggtggtggattgtagcagccagcggctattctccgtgcccccagacctgccaatggacacccgaaacctcagcctggcccacaaccgcatcacagcagtgccgcctggctacctcacatgctacatggagctccaggtgctggatttgcacaacaactccttaatggagctgccccggggcctcttcctccatgccaagcgcttggcacacttggacctgagctacaacaatttcagccatgtgccagccgacatgttccaggaggcccatgggctagtccacatcgacctgagccacaacccctggctgcggagggtgcatccccaggcctttcagggcctcatgcagctccgagacctggacctcagttatgggggcctggccttcctcagcctggaggctcttgagggcctaccggggctggtgaccctgcagatcggtggcaatccctgggtgtgtggctgcaccatggaacccctgctgaagtggctgcgaaaccggatccagcgctgtacagcagattctcagctggctgagtgccggggccctcctgaagtcgagggcgccccgctcttctcactcactgaggagagcttcaaggcctgccacctgaccctgaccctggatgattacctattcattgcgttcgtgggcttcgtggtctccattgcttctgtggccaccaacttcctcctgggcatcactgccaactgctgccaccgctggagcaaggccagtgaagaggaagagatctgacatgcctgcctctcatccctccatgctgctgaccgccacagctgctggccaccagacgccctccctgactgctcactctggttccatggtgacctggctgcctcagtcatggttcaagcaaggtggggacactcattttgtatgagcatctgctttgggccaggcggcacgctaggaattgggaacatcagatgaactgactcagtccctgccctcaaggcacttccctctggtcaaggagagagatccaaaaactattccctttaagactatatgtcaggactctgagcacgtcattatggaggcccagaggaggagccatcatctgtatctagcaatgtccatgagaattataagattagagtgatttgtgaactgggtcatcaggaaatatctactttgtcaggtaggcaaagaagggtgtctgcacatggcagaggccagaatatgcatagtgtgctgtgttgagaagagtgaacagttcctggtcacttacttgtatagagggggtgtggcacagaactcaaacctacccctcacctcctgacaccaaaactgtcagctctcagcaatgccagccactgcctacagggagtaagaacacctctatgacagcccctggcctccttccaccagcagctaccaggtgagaccacctcccagtgactgcccccatatgaccaaatgtcaccagttggtgaggtcccaggcagcaggctgaggatggacactttcaatgcccttgctcctgcctctcactcaagttttgcttcagaagagagaggcaggaggcccagcaactggggcagcaagagtcctggcaccttgggatcctaatcatgtgactgttcttgccacagtgctcatgccacagggtctcaccaggaaagtgcactgtgggccacagacccacagcctggcagcacccagagctaaaaggggacaaaggcagcacagttatgaccatatgaggctttgcattttcttctaagcaacttacccacgttaagcatgagggtgagagagctattaaatactaagcccttgccagtgtcaggtactttgaaaagctctctgcacaaaccattccctttgacacacacacacacaaatcttttgaggtgaacgctgttgttcccattttacggatgaggcaactaaggctcagagaggttaaagtcacatgccactatgagcaagataaagtctgtgctctttctactgccccatccaagttggggaacatcaccattccctctagagttatataaattcaaattcaactagagctgacaaagttcctcataaggtccaggcactcctctgggcacttttatatctattgactcacttctttcaattctcacagcaacactgcctggtggtttttattatccccatttgacagatgaattaatcgtagagagttgagtgacttacccaaggttgtctggataagccctagaaggaaggcggtaggcagctccattcagggaaactgcatctaatcagtcagtcaaaaatcaagtaactttacgagcaaagcacaattatcatcatcgtggtcttcttcatcagtttcgtcagcagcatcattatcttccctctatttgttcagcaccggatagttcatgagtatttttgcatcattctccttgacttttcacatccctgtgcaggaggtaaatcaaacatcagtaatcctgttttacagatggggaaaaaagtctcaaggttggatatgacttgctatgtggcaaggttggggctcaaccctaacacagttctctttccagtgctttctcaagtgcttggggaagagaatgcctcagaaggctgggtagtggggccctggaattcagcatccatgaatgtgctagtggataagctaaatagaaggcagccaaacccatctgctgtacagattgaactatgctcacggtagggcaaattgcaggctctgaaacagagactacacaggtaacacctgaataggagactcctgctttacaatgtgtagataaaacatcagcaatggtggccatggtggcagtcatgtgaaaagtaagatctttgggaatcaagaaaggaagctgtgttaaccactcctgctcaagccctgctgcgtgtgttgcaagagatactaagagagcaagaaagctataggtgagaacctctgcagtttaggagaagaacatcaaggcacagtccaacatgctgataagtctggccaggaggagaattaaaacaggggctttccacacctcccttgccccaagctccagcggtattctatcagcccatcctcctggaaagcctgaaaggaatgaaggaggctaataagtcatcttccaggaaggcatccctcactcgtgcttccctgagctagtcaaccaaaagagtcttcagaaactttgctagacctgaagtacttgaacctgtgtcccctgaatctttcttacaacatctgggacaaatccctggccctgtgacatccgaagcagaactgtgccctgctctctccttctgtgatgaccaaggatggtgaactcaagttgttctctacaagccaggccagcaacctaaatacttggagaggaacttttagaaactataatcctgacaaaatagaaaagtttcccataggggcataccataatactataataacctcccaggaactattgtttgccaaaatgtagttaatatattttaagatatatgcttttttgcataggactagaaccagaaaagacaccaaatgcccccttgacatcaatgtcctttctagtgggacaatttggtctccattaatgccaagcctttctgaacaggatacatggcttttaaaggacagatgtttctcctgctgctagaagttcctcagtttactagagcacaatgaggaaagtattcaacctccctactgccaaggaattccctgcttctcccccaccgccatcatcttgtccaagctatcagaagcaaccttctagagataatctaacaatcctgattagaattgctcccatatccctggtgaccacaggcttcattcaaattgtccaaactggttaacatgtatgtgatggggtatctctgcatctgtatgtctgtctgcgaggttccttgtatattggctgtccgctgacttgggacagatctctctagaacttgggttcagttctctgacatagtccactcagccataggctgagtggctaaatatgcataaataagcatgcctaaataggcatatataggttggtgcaaaagtaattgcggtttttgccattaaaaatgatagcaaaaatcccaattacttttgcgtcaatctaatattacattgcttgatagattaagatggaatcccaccaggtttagggtaggactggatgctcaaaaaataaagaaggagaaaaatctgtggcagaggcatcctaatgagaacctgacttctccttgcttccctctgctctctcctgcgcctcagagacttgtccccattgcagaagcttcctccatgctaggccagaggatatcaaagtttagtttggtcaagatttgggccaagaaaattcctttttagaagagccctcatatctgaatcacatcactttgggccagttatctctggtcaccctcagacaaaccctcgtctctttttctcccttcctagaggaattcccagggaactttgcagaaataggtctccagagttgctacagaggttcatggctcctttcgaggagggacatgtatgaaatttgaacagatcaagacaggtgtttgtcttcaaccatgggggaagacctccagcttccattttcccctatacgtgtctgtgctgacatcctttccagcagtagaagactaaaaagatatatcttaacccattcctcaaaaggacatcttcctaaagccagagaaaattgtctgcgcttccccaccccaggaagaggcaaaagggaagtgagggcgtcacaaggtcttttgtaaatcactattgtgtttgtcacagcactgggcggagagctggatccacagagctctcagtttttctaagcactgtcctgtaatgtgctaatgtctgggggtgggagggctggggaggggtggggttagagggaagatgccaacctttgtatggagatgattttataaccatgcacttttgtaactgtgcagaatttttcataaatgtacattaataataaagagtgtatagtttaacaaa

SEQ ID NO: 148146 - DNA, 2769 bp, Homo sapiens
  Payload ID: 9321
  Gene Symbol: LRRC56
  Gene Name: leucine rich repeat containing 56
  Uniprot ID: Q8IYG6
  ENST ID: ENST00000270115
  CDS Start-End: 501-2129
ggagtaggagacagcgcctggaggtggagggcgcccagggccgagctgccagggccggacacctaggctgagccctcagccggccaactcgcctggcacaggggcagctctagacgggatggagaggatgcatcttcagtgtccacacgtggtcaacagataaaagccatggccagaacgttctaagtggctacatgtgcatctgcctgttcacggattccttcgacaaatatttgagcatcccctcctgcgactgtggacagcagaggagcacgcaggccacgtgcaggccacgtgcagcccacagctctggggcgaggcaggccctcaaccgaacacgtatagagacagggtttcaccgtgttagccaggatggtctcaatctcctgacctcgtgatctgcccgccgcggcctcccaaagtgctgggattacaggcgtgagccactgcgccccgccagacgtctgcatctttaaggggcaacaccaggtgacatgtgaatggatctgggctgggacagatcccgtgggcctcggcggagcacctccagcgtccgggtgcgggagctgagctggcaaggcctgcacaacccctgcccacagagcaagggccctggcagtcagagggacagacttggagagcagctggtggaagagtacctgtcccctgcccggctgcaggccctggcccgggtggatgaccttcggctggtgaggacgctggagatgtgtgtggacactcgtgagggcagcctggggaactttggggtgcacctgcccaacctggaccaactgaagctgaacggcagccacctgggctccctgagggacttgggcacgtctctgggccacctgcaggtgctgtggctggctcgctgtggcctcgctgacctggatggcatcgcctctttgccagcacttaaggaactctacgcctcctacaacaacatctcggacctgagcccactgtgcctgctggaacaattggaggtgctggacctggagggcaacagcgtggaggacctggggcaggtgcgctacttgcagctgtgcccacgcctggccatgctcaccctggagggcaacctggtgtgcctacagccggcccctggccccaccaacaaggtgcccaggggctacaactacagggcagaggtgaggaagctcattccccagctgcaggtcctggacgaagtgccggccgcacacacaggcccaccggcccccccgcggctgagccaggactggcttgcggtgaaggaggccatcaagaagggcaacggccttcccccgctggactgtccccgtggagcccccatccggagacttgaccccgagctgtccctgcctgagacgcagtcccgggcctccaggccctggcccttctccctgctggtccgtgggggccccctgcctgaaggcctgctttctgaggacctggccccagaagataacaccagcagcctcacccatggtgctggccaagtcctctgtgggaaccccaccaagggcctgcgggagcgtaggcaccagtgccaggccagggagccccccgagcagctgccccaacacaggccaggagatccggccgccagcacttccaccccagagcctgaccctgcagacagctctgacttcctggccttggctgggctcagggcctggagggaacatggcgtgcgccccctcccctataggcacccggagtcccaacaggaaggggctgtagccccctggggcccacggagggtccctgaagagcaagtgcaccaggcagagcccaagactccctccagccccccaagcctggcctcagagccctccgggacctcgagccagcacctggtcccttcacctcccaagcacccaaggccacgagattctggcagcagctccccgcggtggtcgacagacctgcagtccagggggcgtcggctccgagtcctgggcagctgggggcctggcctgggtgatggggtggctgcagtgcctgtcctgagagccctggaggtggcctcacgcctgagccctcgagcccagggatgtcctggcccaaagccagcaccagatgcagcagctagacctcccagggcagctgaactctctcaccccagccccgtccccacttaatatagcccccactgccaggcttccctgtgctggggccacgacttgcccacatatgtggtcacagagcacagaatacctgggcgggtgtgttggggggtggaaggagtgcctggccctggggaggaccctcttggtggaggggagtgggggactgggaccagccagggaggcagcagaggctggaacccagtttaggcccccaactgggtttggcctggggagggagggtccggctccccagcccttccttagggccaggctttcccgcgggcacgggggtggggggtggtcacccgagcaggcctgtgagaggcctctcctgctagaattgggcatggccgaggggcaggggctggagctgcgagtccaccactcccttgccggccccagggtaagagccacctcctaggccgcagtggcccaaggtcccagctgctcgcctgaggccgccgggggtgcggtccaggcctcccgtctccgggggatctgtagggttcccgcactgcgatagggcggcccgttccctcctcttggcgcaggacgccccggaacccaaaccaacatttccagctctcaggtgtacagaaatgcggtttactttgtaggccacgttggttcaataaatgatgcagcggacaca

SEQ ID NO: 148147 - DNA, 2769 bp, Homo sapiens
  Payload ID: 9321
  Gene Symbol: LRRC56
  Gene Name: leucine rich repeat containing 56
  ENST ID: ENST00000611111
  CDS Start-End: 501-2129
ggagtaggagacagcgcctggaggtggagggcgcccagggccgagctgccagggccggacacctaggctgagccctcagccggccaactcgcctggcacaggggcagctctagacgggatggagaggatgcatcttcagtgtccacacgtggtcaacagataaaagccatggccagaacgttctaagtggctacatgtgcatctgcctgttcacggattccttcgacaaatatttgagcatcccctcctgcgactgtggacagcagaggagcacgcaggccacgtgcaggccacgtgcagcccacagctctggggcgaggcaggccctcaaccgaacacgtatagagacagggtttcaccgtgttagccaggatggtctcaatctcctgacctcgtgatctgcccgccgcggcctcccaaagtgctgggattacaggcgtgagccactgcgccccgccagacgtctgcatctttaaggggcaacaccaggtgacatgtgaatggatctgggctgggacagatcccgtgggcctcggcggagcacctccagcgtccgggtgcgggagctgagctggcaaggcctgcacaacccctgcccacagagcaagggccctggcagtcagagggacagacttggagagcagctggtggaagagtacctgtcccctgcccggctgcaggccctggcccgggtggatgaccttcggctggtgaggacgctggagatgtgtgtggacactcgtgagggcagcctggggaactttggggtgcacctgcccaacctggaccaactgaagctgaacggcagccacctgggctccctgagggacttgggcacgtctctgggccacctgcaggtgctgtggctggctcgctgtggccttgctgacctggatggcatcgcctctttgccagcacttaaggaactctacgcctcctacaacaacatctcggacctgagcccactgtgcctgctggaacaattggaggtgctggacctggagggcaacagcgtggaggacctggggcaggtgcgctacttgcagctgtgcccacgcctggccatgctcaccctggagggcaacctggtgtgcctacagccggcccctggccccaccaacaaggtgcccaggggctacaactacagggcagaggtgaggaagctcattccccagctgcaggtcctggacgaagtgccggccgcacacacaggcccaccggcccccccgcggctgagccaggactggcttgcggtgaaggaggccatcaagaagggcaacggccttcccccgctggactgtccccgtggagcccccatccggagacttgaccccgagctgtccctgcctgagacgcagtcccgggcctccaggccctggcccttctccctgctggtccatgggggccccctgcctgaaggcctgctttctgaggacctggccccagaagataacaccagcagcctcacccatggtgctggccaagtcctctgtgggaaccccaccaagggcctgcgggagcgtaggcaccagtgccaggccagggagccccccgagcagctgccccaacacaggccaggagatccggccgccagcacttccaccccagagcctgaccctgcagacagctctgacttcctggccttggctgggctcagggcctggagggaacatggcgtgcgccccctcccctataggcacccggagtcccaacaggaaggggctgtagccccctggggcccacggagggtccctgaagagcaagtgcaccaggcagagcccaagactccctccagccccccaagcctggcctcagagccctccgggacctcgagccagcacctggtcccttcacctcccaagcacccaaggccacgagattctggcagcagctccccgcggtggtcgacagacctgcagtccagggggcgtcggctccgagtcctgggcagctgggggcctggcctgggtgatggggtggctgcagtgcctgtcctgagagccctggaggtggcctcaggcctgagccctcgagcccagggatgtcctggcccaaagccagcaccacatgcagcagctagacctcccagggcagctgaactctctcaccccagccccgtccccacttaatatagcccccactgccaggcttgcctgtgctggggccacgacttgcccacatatgtggtcacagagcacagaatacctgggcgggtgtgttggggggtggaaggagtgcctggccctggggaggaccctcttggtggaggggagtgggggactgggaccagccagggaggcagcagaggctggaacccagtttaggcccccaactgggtttggcctggggagggagggtccggctccccagcccttccttagggccaggctttcccgcgggcacgggggtggggggtggtcacccgagcaggcctgtgagaggcctctcctgctagaattgggcatggccgaggggcaggggctggagctgcgagtccaccactcccttgccagccccagggtaagagccacctcctaggccgcagtggcccaaggtcccagctgctcgcctgaggccgccgggggtgcggtccaggcctcccgtctccgggggatctgtagggttcccgcactgcgatagggcggcccgtcccctcctcttggcgcaggacgccccggaacccaaaccaacatttccagctctcaggtgtacagaaatgcggtttactttgtaggccacgttggttcaataaatgatgcagcggacaca

SEQ ID NO: 148148 - DNA, 7351 bp, Homo sapiens
  Payload ID: 9322
  Gene Symbol: LRRC57
  Gene Name: leucine rich repeat containing 57
  Uniprot ID: Q8N9N7
  ENST ID: ENST00000323443
  CDS Start-End: 369-1088
gatgacgtcacagggcgttcccgcccgggactaagccggggagcgcatcccggctactgcgggtcctgggtcttcacctgcggagccttacggcagctgagcggtgggaggcgagtccggggctccctgatcttccgtaggctcccagaggcgcctggcctccgcagagctgcaaaggcggcagggcttggtggtcgggctgtgtgttcttccgtttcttccttgtcgctcttgggtcgggccccaggagccagggatcggcgggagttgagagctggggcaggagccccagccgggaggccgaccgggtggactgggcggtgacagcagcgcttccttcccgcagggacctgagccgcggcgctaggatgggaaacagtgcgctccgcgctcatgtggaaacggcgcagaaaactggtgtctttcagcttaaggaccgagggctgaccgagttccccgcagacttgcagaagctgacgagcaatctcaggaccatcgacttgtccaacaacaagatcgaaagcctaccgcctttgctgataggaaagttcactctgctgaagagcctctccctgaacaacaacaaactgactgttctgcctgatgagatatgcaatctgaaaaaactagagacgctaagcctaaacaacaatcaccttagagagctgccgtctacctttgggcaactctctgccctcaagaccctgagcctctctgggaaccaactgggagcattacctccccaactttgtagcctacggcacctggatgtgatggatctctctaagaaccagattcgaagtatacctgactcagtgggagagctgcaagtcatcgaactcaacctcaaccagaatcagatatctcagatctcagtgaagatatcttgctgtccacgccttaaaattcttcgcctggaagagaattgtcttgagctcagcatgcttccccagagcatcctcagtgattcccagatctgtctgcttgctgtggaaggcaatctttttgaaataaagaaacttcgagaactggaaggctatgataagtacatggagaggttcacagccaccaagaagaagtttgcgtgaagttctccaggactatggaaaccttacaggatactgacttagaacctctgttggaatgtggctgagtcaaagcctcctgttgttgttaggggtatctacagtaaggagatgatacttcaggagattatatttcactcaatgatcttttctcatttcagggctcttctcaaataagctaaaagaaaaaggatcaggagacaggaaaagtcttccgttttgagtcatgagtagggcaatagacaaggttctcttcaaaaccatcattagtttggctttaagaaaccagtagctagctgctatttatatggtgagggggtgctgcctggtaacagaatagctccacaccacagcttgagattttgtttagtttcactgtgtgagctttcataaagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtgcactttggcctgggcatggtggctcatgcctataatcccagcactttgggaggccaaggcgggtggctcacttgaggctaggagttcaagactagcgtggccaacatgaggaaaccctgtctctactaaaaatacaaaaattagctgggtgtgttggtgcatgcttataatcccagctacttgggaggctgaggcaggagaatcgcttgaacccaggaggtggaggttgcagtgagccgagattatgccactgtactccagcgtgggtgacagagtgagactctgtctcaaattaaaaaaataaaaaataattttttttttttaaagtacgctttgttggctgggcacggcgactcacgcctgtaatcccagcacattgggaggccaaggcaggcagatcacgaggttaggagttcgagaccagcctggccaacatggtgaaaccctgtctctactgaaaatacaaaaattagctgggcgtggtggtgggtacctgtaatcccagctacttgggaggctgaggcaggagaattgcttgaacccaggaggcagaggttgcagtgagccgagatcatgccattgcactccgactctgggcaacagagcaagactctgtctcgggggaaacaaaaaaaaagtgtgctttgtcaagagaagcaccagcagacctctaagaactgctctctaaggctgcggtagcaaattatctactattgcaggtgccttattggtagagggctctgaagagccaaaactgtatatgcaacacttgtaagataaaagggactttaataatcaagattttcttgaagatttgttagaaataatgtcttatttctggtaacctttccctttttgtatttataactctactaaccaaattacctatcaataaaccattactataatattttaaaacaacctatgtttatcaagcttactctctgagtgacagaatatactaaataaagaattttttaatgaactttggctggaagcaaggttaatcctttaaaggaggaggacaggagaacttaaacctataaatagattaggaagacatgtttcatgcttatgttcagattgtatgagtagtgaaatgccttcatgtgacataaacattttgtgatactagaactatgcttattaagagaatctgaggttgggcgcggtggctcacgcctgtaatcccagcactttgggaggctgaggtgggtggatcacgaggtcaggagttcaagaccagcctgaccaatgtggtgataccccatctctactaaaaatacaaaaattagctgggtgtggtggcacgtgcctgtaatcccagatactcaggaggctgaggcaggagaattgcttgaaaccgggaggcggagcttgcagtgagggtgccattgaactccagcctgggcaatagagtgagactgcgtctcaaaaaaaaaaaaaaaggccgggcgcggtggctcacgcctgtaatcccagcactttgggaggccgaggcgggcagatcacgaggtcaagagatcgagaccatcctggctaacacggtgaaaccctgtcactactaaaaatacaaaaaattagccgggcgtagtggtgggcgcctgtagtctcagctacatgggaggctgaggcaggagaatggcgtgaacccgggaggcggagcttgcagtgagcggagatcttgccactgcactccagcctgggtgacagagccagactccatctcaaaaaaaaaaaaaaaagaatctgaaggtacaaaggtagaggatttcagactaccactaacatcaacatttagaaagctaccattttggtcattttctgattttatcttagtcacaaagctattactaactatatatcaacagttctcaataatggttaaacctagcttatccattaagtcaagagatcacacaaacctactatttaacctccacgacaaaatctttctgacgtaaatctggtctaggtgttctctttttcccatatgttactttcttttttgagacagaatttcattccagactggagcgcagtagcactatcttggctcactgcaacctccacctaccaggttcaactgattcttgtgcctcattctcctgagtaattgggattacaggcatgcaccaccacacccagctcatttttgtatttttagtagagacagggtttcaccgtgttggccagactggtcttgaactcctggcttcaggtgatccacccacctcagcctcccaaagtgctgggattacaggtgggagccaacacacccagcctcccatatgtcattttctatttctcactttgaaaggggtactagtttatccataccagtttaggagttttgttttttctaaattttaatgtttattaatcttattgatctactgaacaattaacatttctgtgttttatcagtacttctcatctaataaatcagaacttatacattttttttttttttctgagacggagtctcattctttcacccaggctggagtgcagtggtgcgatcttggctcattgcaacctctgcctcccaggttcaagcaattctcctgcctcagcctcctgagtagctggtactacaggcaggcgcacgccaccacgccctgctaattttttgtattttagtagagatggggtttcaccatgttggccaggctagtctcgaactcctgacctcaggtgatccacccgccttggtctcccaaagggctgggattacaggcgtgagccaccacgcctggccagaacttatacatttaacaatttaaatgttcccatttaattattaattggagtttaatccacactcttatcagaatccacaactaccacccttcacaatttgggcctagacttattgccctttcttcactctcatttgcctgcccacccatatcagattattctctctaaacccacagtgcagtcttttctgacctcctttatacagcttgtccctcagtgtccatggaggattggtttcaatacctccatggataccaagtccatgatgctcaagtcccttatacaaaatgacatagtatcttcctgatactttaaattatctctagattacttataatacctaatatgcctacacataacttcatttgcatagattcaacatagtatttgatgcatgctaaattaaggttttgttttttagaaatttgaggcattttcccgctcaaatatttctgacctgcagttgaatccacagatgtggaacccatggatacttagggccaactgtattgttcactcagttgggaatgccctttttttttttttttttggtccagaggctcactcttgcccacgctggagtacaatggcgcgatcttggctcactgcaacctccgcctcccgggttcaagtgattctcctgcctcagcctcctgagtagctgggattacaggcaggtgccaccacacctggctaatttttgtatttttagtagagacggggtttcaccatgttggtcaggctgatctcaaactcctgacctcagttgatccacctgccttggcctcccaaaatgctgggaattgcaggcgtgagctaacgtgcccagcctgccctctcttaattaatatgctcattctgtatgtctaagcctctttcctgcgtctaagccgaattaactgctcacccatctgttactatagcacttctcacattctatatttatctttcatgatagactaactctttgagggcaagggctatatacagtaatatgcccaaagttacagcaaacaagatttagatttaaatatgagctaatcaagtaaactagcttgtggtctaaagacccagatttgaatctggccactagtccaagtcacctaattttttttttctttttttgcgacagatcttgctgtgttgcctgggctagtcttaaactggactcaagtgatcctcccatcttggcctcccaaagtattgagattacaggtgtgagccactgcctggcttttaagtctctttttttttttttttttttttgagacagaggctgtctgtttcgcccaggttggaatgcagtggcacaatctcgggtcactgcaacctccacttcctgagttctagcaattctcctgcctcagcctcctgaatagctgggattacaggtgcccaccaccacgcccagctaatttttgtatttttagtaaaatggggtttcactatgttagccaggcttatctcagactcctggcctcaggtgatccccctgccttggcttcccatagtgctgggattacaggtgttagccaccacgcccagcctatatgtattttttgagacagggtcttgctctattgcccaggctgaagtgcagtggcatgatcacagctcacaaatgccttgatctcctgggctcaagctatctcctcccacctcagcctcttaagtagctggagctacaggttatctgccaccacactcagctaatttttaattttttagaaagacggggtcttcctgtgttccccaggctggccccaaactcctgggctcaagcaatcctgccttacctcccaaagtgctgggattacaggtgtgagccaccacatctggcccaagtcacccaaattttttacagcttggtttggaaggcaatgtagtatattaaaattatgggccctggagtcagaaagatccaggtttgaatacagagtccgtcatttattagctttatgaatttgagcaatttcgtctcacttgtaaatatagggaatagctcctacctctcaggtatgttgcaaaaaactatataaaagcacttagcatagtggccatgacagagtaagcactcagtaaatcatgccatttatctcatctataaggcatgaaagtagaattttacaagttgtacagaaatagaaggcttggagtggacactacattaaaaggataaaaaaatggagccaggcagaggcaggcatctatagtcccagctattgaggaggcctgaggctggaggatcccttgaacctaggagtttgaggccagcctggacaacaatgtgagattgtggctccaaaaaaataataaaaaataggctgctctgcctatggagtagccattcttttattcctttacttttttaataaacttgcttttactttatggaaaaaataaatttttaaatgactagatgagaaacttgaatatcaatctgagaaataaaatctgattaggaatgtaattgggataacctgaagttttggtaagagtgacctaaagaaaacagcacttagataagctactttgttttcctttttcactttactatttttctgatatatatttgttcatatttatggggtacttgtgatattctgagacatgcatagaatgtataatgatcaagtcaggatatttatgttattcattatctcaaacatttatcatttgtttgtgttgggaacatttcaaatcttctagccattttgaaacttacattaagtatagtcaccgtactatgctatcaagcattaaaacttattccttctatctaactgtatgtttgtatctacccattaacctaccttccttcatcgccccaccctgtacacccactacccagcctctggtaactatcattctactctctacctccatgaaataaattttttagctcacatgagtaagaacatgca

SEQ ID NO: 148149 - DNA, 2384 bp, Homo sapiens
  Payload ID: 9322
  Gene Symbol: LRRC57
  Gene Name: leucine rich repeat containing 57
  Uniprot ID: Q8N9N7
  ENST ID: ENST00000397130
  CDS Start-End: 104-823
actaagccggggagcgcatcccggctactgcgggtcctgggtcttcacctgcggagccttacggcagctgagcggtgggagggacctgagccgcggcgctaggatgggaaacagtgcgctccgcgctcatgtggaaacggcgcagaaaactggtgtctttcagcttaaggaccgagggctgaccgagttccccgcagacttgcagaagctgacgagcaatctcaggaccatcgacttgtccaacaacaagatcgaaagcctaccgcctttgctgataggaaagttcactctgctgaagagcctctccctgaacaacaacaaactgactgttctgcctgatgagatatgcaatctgaaaaaactagagacgctaagcctaaacaacaatcaccttagagagctgccgtctacctttgggcaactctctgccctcaagaccctgagcctctctgggaaccaactgggagcattacctccccaactttgtagcctacggcacctggatgtgatggatctctctaagaaccagattcgaagtatacctgactcagtgggagagctgcaagtcatcgaactcaacctcaaccagaatcagatatctcagatctcagtgaagatatcttgctgtccacgccttaaaattcttcgcctggaagagaattgtcttgagctcagcatgcttccccagagcatcctcagtgattcccagatctgtctgcttgctgtggaaggcaatctttttgaaataaagaaacttcgagaactggaaggctatgataagtacatggagaggttcacagccaccaagaagaagtttgcgtgaagttctccaggactatggaaaccttacaggatactgacttagaacctctgttggaatgtggctgagtcaaagcctcctgttgttgttaggggtatctacagtaaggagatgatacttcaggagattatatttcactcaatgatcttttctcatttcagggctcttctcaaataagctaaaagaaaaaggatcaggagacaggaaaagtcttccgttttgagtcatgagtagggcaatagacaaggttctcttcaaaaccatcattagtttggctttaagaaaccagtagctagctgctatttatatggtgagggggtgctgcctggtaacagaatagctccacaccacagcttgagattttgtttagtttcactgtgtgagctttcataaagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtgcactttggcctgggcatggtggctcatgcctataatcccagcactttgggaggccaaggcgggtggctcacttgaggctaggagttcaagactagcgtggccaacatgaggaaaccctgtctctactaaaaatacaaaaattagctgggtgtgttggtgcatgcttataatcccagctacttgggaggctgaggcaggagaatcgcttgaacccaggaggtggaggttgcagtgagccgagattatgccactgtactccagcgtgggtgacagagtgagactctgtctcaaattaaaaaaataaaaaataattttttttttttaaagtacgctttgttggctgggcacggcgactcacgcctgtaatcccagcacattgggaggccaaggcaggcagatcacgaggttaggagttcgagaccagcctggccaacatggtgaaaccctgtctctactgaaaatacaaaaattagctgggcgtggtggtgggtacctgtaatcccagctacttgggaggctgaggcaggagaattgcttgaacccaggaggcagaggttgcagtgagccgagatcatgccattgcactccgactctgggcaacagagcaagactctgtctcgggggaaacaaaaaaaaagtgtgctttgtcaagagaagcaccagcagacctctaagaactgctctctaaggctgcggtagcaaattatctactattgcaggtgccttattggtagagggctctgaagagccaaaactgtatatgcaacacttgtaagataaaagggactttaataatcaagattttcttgaagatttgttagaaataatgtcttatttctggtaacctttccctttttgtatttataactctactaaccaaattacctatcaataaaccattactataatattttaaaacaacctatgtttatcaagcttactctctgagtgacagaatatactaaataaagaattttttaatgaa

SEQ ID NO: 148150 - DNA, 2407 bp, Homo sapiens
  Payload ID: 9322
  Gene Symbol: LRRC57
  Gene Name: leucine rich repeat containing 57
  Uniprot ID: Q8N9N7
  ENST ID: ENST00000563454
  CDS Start-End: 129-848
ctaagccggggagcgcatcccggctactgcgggtcctgggtcttcacctgcggagccttacggcagctgagcggtgggaggcgagtccggggctccctgatcttccggacctgagccgcggcgctaggatgggaaacagtgcgctccgcgctcatgtggaaacggcgcagaaaactggtgtctttcagcttaaggaccgagggctgaccgagttccccgcagacttgcagaagctgacgagcaatctcaggaccatcgacttgtccaacaacaagatcgaaagcctaccgcctttgctgataggaaagttcactctgctgaagagcctctccctgaacaacaacaaactgactgttctgcctgatgagatatgcaatctgaaaaaactagagacgctaagcctaaacaacaatcaccttagagagctgccgtctacctttgggcaactctctgccctcaagaccctgagcctctctgggaaccaactgggagcattacctccccaactttgtagcctacggcacctggatgtgatggatctctctaagaaccagattcgaagtatacctgactcagtgggagagctgcaagtcatcgaactcaacctcaaccagaatcagatatctcagatctcagtgaagatatcttgctgtccacgccttaaaattcttcgcctggaagagaattgtcttgagctcagcatgcttccccagagcatcctcagtgattcccagatctgtctgcttgctgtggaaggcaatctttttgaaataaagaaacttcgagaactggaaggctatgataagtacatggagaggttcacagccaccaagaagaagtttgcgtgaagttctccaggactatggaaaccttacaggatactgacttagaacctctgttggaatgtggctgagtcaaagcctcctgttgttgttaggggtatctacagtaaggagatgatacttcaggagattatatttcactcaatgatcttttctcatttcagggctcttctcaaataagctaaaagaaaaaggatcaggagacaggaaaagtcttccgttttgagtcatgagtagggcaatagacaaggttctcttcaaaaccatcattagtttggctttaagaaaccagtagctagctgctatttatatggtgagggggtgctgcctggtaacagaatagctccacaccacagcttgagattttgtttagtttcactgtgtgagctttcataaagtctgttgccattccatctctgtgttaacacttcatatttttatgaaattcagataatttgtgagaggctggcatggatctaaggatttattatttttattctagtccatcagttcagtcgcagtttttatactaggactttaggatgtacataaatgtgtgactgtttgtcttgattaaaagtgcactttggcctgggcatggtggctcatgcctataatcccagcactttgggaggccaaggcgggtggctcacttgaggctaggagttcaagactagcgtggccaacatgaggaaaccctgtctctactaaaaatacaaaaattagctgggtgtgttggtgcatgcttataatcccagctacttgggaggctgaggcaggagaatcgcttgaacccaggaggtggaggttgcagtgagccgagattatgccactgtactccagcgtgggtgacagagtgagactctgtctcaaattaaaaaaataaaaaataattttttttttttaaagtacgctttgttggctgggcacggcgactcacgcctgtaatcccagcacattgggaggccaaggcaggcagatcacgaggttaggagttcgagaccagcctggccaacatggtgaaaccctgtctctactgaaaatacaaaaattagctgggcgtggtggtgggtacctgtaatcccagctacttgggaggctgaggcaggagaattgcttgaacccaggaggcagaggttgcagtgagccgagatcatgccattgcactccgactctgggcaacagagcaagactctgtctcgggggaaacaaaaaaaaagtgtgctttgtcaagagaagcaccagcagacctctaagaactgctctctaaggctgcggtagcaaattatctactattgcaggtgccttattggtagagggctctgaagagccaaaactgtatatgcaacacttgtaagataaaagggactttaataatcaagattttcttgaagatttgttagaaataatgtcttatttctggtaacctttccctttttgtatttataactctactaaccaaattacctatcaataaaccattactataatattttaaaacaacctatgtttatcaagcttactctctgagtgacagaatatactaaataaagaattttttaatg

SEQ ID NO: 148151 - DNA, 561 bp, Homo sapiens
  Payload ID: 9322
  Gene Symbol: LRRC57
  Gene Name: leucine rich repeat containing 57
  ENST ID: ENST00000570160
  CDS Start-End: 117-561
acagggcgttcccgcccgggactaagccggggagcgcatcccggctactgcgggtcctgggtcttcacctgcggagccttacggcagctgagcgggacctgagccgcggcgctaggatgggaaacagtgcgctccgcgctcatgtggaaacggcgcagaaaactggtgtctttcagcttaaggaccgagggctgaccgagttccccgcagacttgcagaagctgacgagcaatctcaggaccatcgacttgtccaacaacaagatcgaaagcctaccgcctttgctgataggaaagttcactctgctgaagagcctctccctgaacaacaacaaactgactgttctgcctgatgagatatgcaatctgaaaaaactagagacgctaagcctaaacaacaatcaccttagagagctgccgtctacctttgggcaactctctgccctcaagaccctgagcctctctgggaaccaactgggagcattacctccccaactttgtagcctacggcacctggatgtgatggatctctctaagaaccagattcgaagtatacctgact

SEQ ID NO: 148152 - DNA, 7903 bp, Homo sapiens
  Payload ID: 9323
  Gene Symbol: LRRC58
  Gene Name: leucine rich repeat containing 58
  Uniprot ID: Q96CX6
  ENST ID: ENST00000295628
  CDS Start-End: 97-1212
ctcggttcaggttccggggcgccgcagagctcccggcctctggaccgcgcgcggcgctctggggaatccggcgccacgcgccgtgcggtggccaggatggaggaggccggagcagcggtggtcacggccggggaggccgaactgaactggtcccgcctcagcgtgtccaccgagacgctggagtctgagctggaggcgcggggggaggagcggcgcggggcgcgggaggcgctgctgcggctgctgctgcctcacaaccgtctggtgtcgctgccacgggcgctgggcagcggcttcccgcacctccagctgctggacgtgagcggcaacgcgttgaccgcgctcgggccggagctgctcgctctgcgcggcctgcgcacgctgctggccaagaacaaccggctcggcgggcccagtgcgctgcccaagggcctggcccagtcgccgctctgccgcagcctccaggtgctcaacctcagcggcaactgtttccaggaggtgcctgcctcgctcttagagctgcgcgcgctgcagaccctgagcctgggcggcaaccaactgcagagcatcccggctgagatcgagaacttgcagagtttagagtgtttatatcttggaggaaatttcattaaagaaatcccaccagaattaggaaatctgccttctctgaattatttggtattatgtgacaacaaaatccaaagcatacctcctcaactttcacagttacattcacttcgttccctaagtcttcacaataacttgctgacatatctgcctcgagagatcctcaaccttattcatttggaagagttgagtttacgaggaaatccattggttgttcgttttgttagagatttaacctatgatcctccaactctcctggaattagctgcacggaccattaagattcgaaatatttcctacactccctatgatcttcctggaaatcttcttagatacttgggttcagccagcaattgcccaaacccaaagtgtggaggagtctactttgactgctgtgtcagacaaattaaatttgtggacttctgtgggaagtatcgcctcccactgatgcactacttgtgttcaccagaatgttcttccccttgcagttctgcctctcacagctccacttcccagagtgaatctgactcagaagatgaagctagtgttgctgcacgcagaatgcagaaagttcttcttggttgaacaggagtgcacagtgttgtgaaatacttaaaaaactgagcaaaatggttagacaagaaaatagagcttgaagttcactagaaatcttatcttcatcttaagtgttcatcaaagagtctgggatgatataaaacattttgtgtttcatctacccattcagcaagaatgagtccagtcccatgtttagattattttaacataatttgtgaatgatagtttcacatttggctgatggtttgcagttttcactcaagttttgcatgaatcacaaagcagaatggtaccttttgaagagcagttctgcaataagtcatgagtagtataacttttggacattgagatggagaaagtgagaaattatcaaagctataattgccagagttgcccttgggtttaggtagaacactgtataccatatatactatataccatatatactatatataccatatatattatatgccataaacaggattaaccctcccttttctaattgcctgtatgtctagattacagaactattcaaagaagctcacagatggttacatgggacaaacctttctgacaaactaactggtaaagtaaggcatataacatttacatgagatattaaaactttttcattattatcctttgttctatatgattgctattaaccttatgtaatctagcaatgactgttatagtgccttaatccagcaaggatataaaaatgtattcaagaagtaatgccagagcaacctataacctgacataccatgcagaacattgtaaaatattctttaacagaactaggtaaataactgtgtatctaatatccgatctcatggccctcttaacatttttttgtttaaatgtgcactcatcccttataagcacattacttttacacttaatggtaggccacaatcttcatcaatctgttcatcataagacagagtaagaatttttaacagaaaattctaaaagagatagaagctaggaaagcttctttatatcttgcattaaatgggtagggaaaaaatatgactctcacccatgtcatgtactggaccatctttctctactttttaaagaaaaactaatacaactagaaaaacatcacaacaagccaaataaaaatggagaaaaggagtcattgtccttatacctaatggaacagtttccagaactactttaactatggaagcatttttgaaaataaagtattaataaaatagaaaaaaattattaaatatattgtatccttaatgtatagcaggaaaatagtttcacaaattaattgctattagaaattaccaaatttttattaagtactttaatatgcaatacaaattgaataatagtacaactataagttgatataaagtaagtgcttactggtaatcattaaataactaataacatgacttgttggttaatgttaaacctacagtaagaaatgttatacagatcagataggcattagaacatcaggtgtaccttttctgatttctggcattcatggcacaccatttcttaaaagcagattgttgtataataacatatacatgtattagggtttttttcatatatattttttattttagaagaaactagcataattcagggtttatgtgtttatttgtatattaattcatgaaacatgagagtttcatgaactgcagatgtgaaacgctgctatagaatgaatcccttcacctttaccttgttataatgtagtaagattttgttttccttttgactcagaaattttctatgtctatagaggtaatctaatatgttcctactgcctagaagagtaatacataggtgattatatcataaaatagaggtataaagtctttgcttacttctccatgtgggccacagcaagctgcagactgtacagttatgaaaggtaaagatgacttaggctgtgcctaagtgacaaatgtaaaatgttttgtaaataagtgacttacctaagatacataagatattttcatagaaaataatgtattcatagtaaaatactcaaattgataggaccaattttttctggcctaaatgcttatgcctacttcctaatcaattaccagcttgacttaagtaactgcttgagtagtcttctaagagttagtcttcgtaaaataaatggataggtatgtaaatatataatcttacataccctttccagcttcctagaaaggtctactgcttcatcttttacagatgtaaataggtccaaccagagacagtttctggcctttgcatataagaatatagatgtataccacagtattatttcaacaaaatgttatggttctatgtatagttgaaaactctatgatcagcatacaactgtcttttggtaatttttaatgaagtctacatttagccgtcggttttatctttcttaaatctttgacctaaacttttgtaagagcagctaataatttctaagattttccctgtttctttttcctacctttccttttctcataactgattggagaaattaatcagaagtcaaatacaagggacttcataatctagaaaccagataatcagctcccaagtcatgtagctaactatgcatttaaaataagtctgtctctttagttcttaagtcatatatttgtttgttaattacagtaaatgaactttaattggggtttttaaaagacagaattagcgaagtctaatttttataatgaaataagtttttgatattgctctacttggacgattttagtgaccaaaactatggataaaactgcctaagcataacattaatatatttagaatggcattcttcagtgctagtatttgaaattggaattagtacattgtgcattcttagtagtctttatccctagaatcaattctctcagcatcaccaaactgaattggtgaaatagtgctaagattctgggcaataggaagattagtgaatatgatacattgattccagggtgccagggattggctgacattaaggaccagctggctatggtcctcaggctacggtcctcagtattctagtatttgagtagtggaggtaaatccaaaggcgactggttatattttacttctaaatgtgtgctgaagtgtctcttgttcaaaaattcttgatatttagagcttcaagttaccacatttaaaagtaaagacttggcacggtggcacacacctataatcttagcactttgggaggccgaagtggatggatcatatgcagtcaggaatttgagaccagcctggccaacatggtgaaacctcatctttactaaaaatacaaaaattagccgggcgttgtgacgcacacccatagtcccagctaactccggaggctaagacaagagaatcacttgaacttgggagacagaggttgcagtaatctgagatcactccgctgcactccagcctgagtgagagtgagactgtgtctcaaacaaacaaacaaaaaacaaacaaaaaaatttgcattgtaaattgtacctcaaatttgagcagtttttgtgtttgtgtaaattaaagtaaaaagcagtccacaataatgttttgtaatactgcacaccagttctaccagattttgtaactatcagatttaaatgaaaaaagagaaggaagaggctgattgctggagtgttaaagaaatcttggccgggcgtggtggctcacgcttgtaatcccagcactttgggaggccgaggcgggtggatcacgaggtcaggagatcgagaccatcctggctaacacggtgaaaccccgtctctactaaaaatacaaaaaaaaattagccgggcgtgatggcgggcgcctgtagtcccagctactcgggaggctgaggcaagagaatggcgtgaacccgggaggcggagcttgcagtgagccgagattgcgccactgcactcccgcctgggccacagagcgagactccgtctcaaaaaaaaaaaaaaaaaaaaaagaaatctttagaagccacagggctagaagagaagtcaccaaacacctagggacagtcctaggcctagaaagccctttaaagtaatagtgaattgttttaaaattaagttattgagtggcctactgactaccatccaaaaacctttatcaccaaatttgttcagtgtttgctattgggagattgtccatatccctccgtaattaagggccagcaagtaatacgatcttcttacagccaaccttgctcttcccaaagggagaaagtaatacatcattaacctggaatttgtgatataacaggtagccttggttaatgtttaccttttcactatgtaaaaaagaaaaaacacacagcaaatagtgcaaataaaatttggtcttttaaagcattttagcagtagctatgtaaaaaaagttaatggttattattcctaaattttcataagacccttggtagacaaaactatcggttatattatgtatatatgaggttagttaagctgcatttagttaggaacatttaatttttacctaaatgatccttttttcatccagaggtagagattttattgtcattatgaatgttactccccatttagtccaaaatagtgagcttttaagttgtgccaggtacttaacaatagtaaaagctattgtatagatttttattcaatgtgacctataatacatttctgattccttctgtattgaatgtcccagtttccatattaagtgctatgccctgtataacattaatgaatttaatagtgtacaattttgggccaggcatggtggctcacgccagtaatcctggcactttgggaggcagaggcaggcagatcacctgaggtcaggggttcgagatcagcctggccaacatggcaaaatcacatctctactaaaaatacaaaaattagccaggcgtggtggtgcatgcctgtagtcccagctactcaggaggctgaggcaggagaatcgcttgaacccaggaggcggaggttgcagtgagccgagatcatgccattgcactccagcctgggagacagagcaagactctatctcaaaaataaaaataaaaaaaaaattgcgtgcaattttgtattttcatagtcgtatctttttaaaggtatcatgatttcagttgtggtcaggaagtatgtgccttaaatcctctactctagacccaaagtttggagagctatattatttaataagttgtttgtgacagccttgttacctttttcatttgatttgagggagaaagactgtgatcctgacagattccttctcataaaatggcctaatgtgtatcagtctaggacttctggggagggaacctctaccatgcattctgtcccaggatgtcaaagtcataagaatcagggtcccctgaaataaaatcactgaaaagatatgttctgttatatattatttaaaaaatttatctggtgccaccaaagaatgacagcagtttctaaccaacttcatatttatagcatcttatgaagatattgtaaggcttagcatattttgccactggttttctttgtaatataggttgaaagtgagacatgtttgaatacttttgtatgtaaatatctcccattctttttctatctcttcttggtctatatttactaagaattgatatttaaaaaacagttcactaatgaactctacatattattgaacactcacagggcaatattgatttgggtgctactagacttttacctaacattagtctttctcaatagttgttgtaaaggatagtattcaatccagtaaatattaaagtgtattagtttaatgaaggttatttatatactgtcataccacaaacctatggtggaaagaacatctgcattcaccagaatgtacttgttcctttggctgtgaataaattggataagacttttttattgtaagttccagctgttggaagatacggggataagattgacattgctgttgcagtattgcaaaaacatgactaaattggttaattatgtctaccgcttatgtttaagagaatcctttcactaacttaaattgttaacattgttgtgatattgagaaagaatattaacctaaacagtcactttacaacaatcatgtaaagacgtgtgcctgcagttgaggttttttgcatttctgagcctgctttgtattcatgagaaacaaaaacataatgggagaaaagttttagataagcagcattgtaagtttttgtaaagtttgggatgtcaaagtattaacgaagggtactgaaaacatacttttacttgggtcaaattactttttatgatctgatttcttaattttctgtatttgaaatcttgcaaattaggaatatctacatctatagataaataagtaaaacttaatggtagaaataagtgtaattcagcaacatgattcaacaatttttatatttaggataagttattgtttattatattaatatcaaatttatatattgccttgtaatgctaaatgctcttaaaagaatatatgggctacttcaattctaccaccttcttccccctcccccaggacgtacaaaagatcttatattaaccaatcctctgtgaattttgccatatcaaacattgtgccttattttaataaaactgttttgttggaatccagttctatattaaagtctctataatgttgatatttgcctgattacttgttacatcattgaatacatacattaaatatgtactaacattga

SEQ ID NO: 148153 - DNA, 2910 bp, Homo sapiens
  Payload ID: 9324
  Gene Symbol: LRRC59
  Gene Name: leucine rich repeat containing 59
  Uniprot ID: Q96AG4
  ENST ID: ENST00000225972
  CDS Start-End: 237-1160
atctcagtggtcgcggaaggtgacgtggacacggaagtggtcgtcgtcgcggcaccggtgggagctaggcgcgaggctcggagtgcggccagcgggcggaggcggtctcgcatcggcggcgacggagggctcaggcgtcgtcgtttgggtggggggccgctgaactgacaagcgacatttcagctcctttcacccgccggaaccccggagccggggcccgctcagccggcgttaccatgaccaaggccggtagcaagggcgggaacctccgcgacaagctggacggcaacgaactggacctgagcctcagcgacctgaatgaggtcccggtgaaggagctggctgcccttccaaaggccaccatcctggatctgtcttgtaataaactgactactctaccgtcggatttctgtggcctcacacacctggtgaagctagacctgagtaagaacaagctgcagcagctgccagcagactttggccgtctggtcaacctccagcacctggatctcctcaacaacaagctggtcaccttgcctgtcagctttgctcagctcaagaacctgaagtggttggacctgaaggataaccccctggatcctgtcctggccaaggtggcaggtgactgcttggatgagaagcagtgtaagcagtgtgcaaacaaggtgttacagcacatgaaggccgtgcaggcagatcaggagcgggagaggcagcggcggctggaagtagaacgtgaggcagagaagaagcgtgaggctaagcagcgagctaaggaagctcaggagcgggaactgcggaagcgggagaaggcggaagagaaggagcgccggagaaaggagtatgatgccctcaaagcagccaagcgggagcaggagaagaaacctaagaaggaagcaaatcaggccccgaaatctaagtctggctcccgtccccgcaagccaccaccccggaagcacactcgttcctgggctgtgctgaagctgctgctgctgctgctgctatttggtgtggcgggagggctggttgcttgtcgggtgacagagctgcagcagcagcccctctgcaccagcgtgaacaccatctatgacaatgcggtccagggtctacgccgccatgagatcctccagtgggtcctccagaccgactctcagcagtgagcttgtccccagcacctgctgcctcccagccttggagtttggattcctatggaattgggttctgctggacacaacctctttttagcatcagacctacctgccatcatcaaatggctgcagattggtacatgagacctcctctttgtaggacttcttcattccttagtcagggttccctgaaggaatgaggagaaatgggaggtggcgggggggcgtggggggcagttacctgcatgcctaaaggagtaggcttgggggtggggagagagaaaacatagccttttctagttgttatataaagctgtgtaaaggcaaggctcgtttctactaaatggtcagctgtcactacatttatacttttgtatgccacaaaccctttcattcctccctgggaatcagggtagatcaggaggaactgggggggactagaacaccacgctcagtaaatccagtctaaactgggaggtaggggtattcctgttttctttaggacctcagagatgtaagcattttagcagccacacaaaatctctggctatgaaagggacttcatgaccatccagtccaatataacacttgcagacagagaaactgaggtcttccatgacttgcctagtctcccagctagtttgaggcaaaactggattcccactctggtattctttcttccctttacatcattttccctcctttataatgtcctgagagaccagaactcacaccagaatcgattattcctcaggtgaagcatagactctttcatggtagacagatttcacgactcagagatagaaatctcttgctatcatcaggtcacgggcagctcctgtggagtcctgcccaacttatgtggcttccataaaatggcaacagtccaggctccttgcctaattttagagcattaactccctaattgccagtaagcaaggaggtggatctctgcaaacctacactgtctatgacagctctagttgtacttggtgtgactaaatacctcaaaggcaacctgcttctgcaggttttgaagtgtcagcttcataagacactgaggtttagaattgtttgattctagaccataactgaagggcataaatggaaacaggatatgaagggaaacaagtagcatcatggagctgaaaagtggtgcatcacccaatggctagcacaaacaaggatcacactgtccattctcttgtctgctaaattaagcattttcttgcctcctttgcttcatcttttcacaacagctggatagagggatcagaaatgactgtgtcatggtgctcattcactgcaaactcccagttgcaagctccttggctcccccggagggagcaagaatctcatagttcagagacacagagggccttttagccctaatgaccttttggatgggactgcaactcatgactatcctgatattggaagaaaggactttgttaatcttctcccccatagctctgctgcgtaggtctacatcttactcagaatcactacacattcctttagtcttcctccaagctccagagccattggtacaaatgctttattgaaactaaatacataatacacacaatgagatgaagacaatatagaagtccgcatagtcatcataatcccgttccttggccggttgaggcagctcagtggctgagcccagtcaagccaacccgcagcttcactcacgacttcaagatttgatgctaattcttttggatttctacagttattaaataagtgtctgagtgga

SEQ ID NO: 148154 - DNA, 1531 bp, Homo sapiens
  Payload ID: 9324
  Gene Symbol: LRRC59
  Gene Name: leucine rich repeat containing 59
  ENST ID: ENST00000576448
  CDS Start-End: 188-376
cggcaccggtgggagctaggcgcgaggctcggagtgcggccagcgggcggaggcggtctcgcatcggcggcgacggagggctcaggcgtcgtcgtttgggtggggggccgctgaactgacaagcgacatttcagctcctttcacccgccggaaccccggagccggggcccgctcagccggcgttaccatgaccaaggccggtagcaagggcgggaacctccgcgacaagctggacggcaacgaactggacctgagcctcagcgacctgaatgaggtcccggtgaaggagctggtcagtatcgtcccgcgaggcccaggcgcccaccttcgccgggcgctggcccctacgtgggccacttactttcctcttctctaaaagcatcagtttccttttctttaaaaagaagcggggtggtgggactaagtcccctaggaggccgcgtccagcccaaggttcttcccgggatgtacacgtgtcactttggcgcagttccagaacatagggaagatctgcttctctggccctaggctttttacaggctaagaagcgaatctgtcacctttgcggggctttcacagcgcccacctccgtgcccgactctgagtaggagcacacggagcagttactggatgtattcgagaatgaatgagtgacttgttccaggggagtaggcctcctggtagacctgggtgtggcccagaacctggctcttctaggaagctggcaattccagctggctgcccgagccctgaggcagcctaactcgaagaaagtaaagtctccccccagcttggctggtaaactgtcatctgaattccgctgaaactggcgggagtccctttcgcccctctctcccccaacctttcccctgtaaactgaagcttacagctccagagagatagcaggcatctagttttgtcagcgtggagctagttcccacatccctccttttcccactccgttccccctcccacccgcgccaacgccctactagactcactttgggtgacccacactttgctttctgccgttgataaattacatttgccttgggcgctgggcccagtctttcttccaccgtggacgggtattacagtggttagaaccgggttcctagctcctcccagctccattgcttaatagccgagtgcccttggcaagctagttagcctttatgcctagatctcctcatctatacaatggtgataatagtttccatctcatacgcttattgggaggttaaataccattgtaatggaaaatgcttggaaggagcaaatactgatacttgtagctgttgttgtgtttttcccgctgtagtatttaaaacttttttaggtggtcaaacttcacttttacgactttgtgacagaaagtgcaggttgccagaggatccttaactgaatatatgcctccttttctaccccaggaagatagatggccagccttatttcaccctgccctaggactgctctctgaaaccatatactccaggcatctgaacagtccagcattaaccttagggagaaa

SEQ ID NO: 148155 - DNA, 438 bp, Homo sapiens
  Payload ID: 9324
  Gene Symbol: LRRC59
  Gene Name: leucine rich repeat containing 59
  ENST ID: ENST00000503118
  CDS Start-End: 1-172
agcaaatcaggccccgaggtgctttccttctgccttgcttgtctctgctgccggcatccgtgtgagcctcttccctggaccttctgactcggcttggttttcttctggggtggaaggatgtcagaatttgttttggttactgccaagctgctgctctggccagggcaggtagacaggctgtctcctctttgttgaagatggttccttcttcagaaaggcaaatgttggcaactcctcagagtcactatcaccagaatccagtgagggtgatgacttctttagagccatcagtatgtgctatcaaataattccctaaaaggaaaagagacatatgacacagactggagcattcaattcagtccactagctgtgttccatagccaggctttatgacataaatataagatatagagaatacagaaacagagaaatatgaca

SEQ ID NO: 148156 - DNA, 1672 bp, Homo sapiens
  Payload ID: 9325
  Gene Symbol: LRRC6
  Gene Name: leucine rich repeat containing 6
  ENST ID: ENST00000250173
  CDS Start-End: 67-1302
gaagggtgaaaagcgtcattcgaggtccgggtccggcttgcggggtcagcgaactggagaggcgccatgggctggatcacagaagatcttattagacggaatgctgaacacaacgactgtgtcattttttccctggaggaactctcgttgcatcagcaagaaatagaaagactagaacacattgataaatggtgccgggatttaaaaattctctatcttcaaaataatcttattgggaaaattgaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagctattctactggattctagaggtgatgtttctgacagtcaggtcgtgggtaagaccagtgatgggcgtccgtcctagaggcctctgacattaaggcggggaaagcaaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttgaaacatctggctgcgttgccattggctgagacccaccaggtccagttttggttggtgtagagaccatatgcatattattcctgggataaacacagagttatttgtc

SEQ ID NO: 148157 - DNA, 728 bp, Homo sapiens
  Payload ID: 9325
  Gene Symbol: LRRC6
  Gene Name: leucine rich repeat containing 6
  ENST ID: ENST00000522789
  CDS Start-End: 1-621
gacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaagtatatggatacctctttaatcgatgttgatgtgcaaccaacttacgtgcgagtaatgatcaaaggaaagccatttcagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttgaaacatctggctgcgttgccattggctgagacccaccaggtccagttttggttggtgtagagaccatatgcatattattcctgggataaacacagagttatttgtcaa

SEQ ID NO: 148158 - DNA, 1674 bp, Homo sapiens
  Payload ID: 9325
  Gene Symbol: LRRC6
  Gene Name: leucine rich repeat containing 6
  ENST ID: ENST00000518642
  CDS Start-End: 67-1302
gaagggtgaaaagcgtcattcgaggtccgggtccggcttgcggggtcagcgaactggagaggcgccatgggctggatcacagaagatcttattagacggaatgctgaacacaacgactgtgtcattttttccctggaggaactctcgttgcatcagcaagaaatagaaagactagaacacattgataaatggtgccgggatttaaaaattctctatcttcaaaataatcttattgggaaaattgaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagctattctactggattctagaggtgatgtttctgacagtcaggtcgtgggtaagaccagtgatgggcgtccgtcctagaggcctctgacattaaggcggggaaagcaaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttgaaacatctggctgcgttgccattggctgagacccaccaggtccagttttggttggtgtagagaccatatgcatattattcctgggataaacacagagttatttgtcaa

SEQ ID NO: 148159 - DNA, 453 bp, Homo sapiens
  Payload ID: 9325
  Gene Symbol: LRRC6
  Gene Name: leucine rich repeat containing 6
  ENST ID: ENST00000519085
  CDS Start-End: 1-421
tgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagccatttcagcttgtccttcctgcagaagtgaaacccgatagtagttctgctaaaagatctcagacaacgggtcatttggtcatctgcatgcccaagggtgccaaccaattgatgagaaaagctctactgtcactgtttatgagtcttaaacaactgcagcattcttttccccttttcctttatgtttttaatctgtctaaatttttcacatgaaaataataataaatggcttatgaggaaaaagc

SEQ ID NO: 148160 - DNA, 1736 bp, Homo sapiens
  Payload ID: 9325
  Gene Symbol: LRRC6
  Gene Name: leucine rich repeat containing 6
  Uniprot ID: Q86X45
  ENST ID: ENST00000519595
  CDS Start-End: 100-1500
aattccgacggggacgcgctgaggagcaggggtgaagggtgaaaagcgtcattcgaggtccgggtccggcttgcggggtcagcgaactggagaggcgccatgggctggatcacagaagatcttattagacggaatgctgaacacaacgactgtgtcattttttccctggaggaactctcgttgcatcagcaagaaatagaaagactagaacacattgataaatggtgccgggatttaaaaattctctatcttcaaaataatcttattgggaaaattgaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagccatttcagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttgaaacatctggctgcgttgccattggctgagacccaccaggtccagttttggttggtgtagagaccatatgcatattattcctgggataaacacagagttatttgtcaatatcgctgctccagtgttttaactcttactttgcatagtaatatccttaagatagcttaaaattaaaatgtatgtcttaaatgctataactcatcatttacctataataaagggttggtattgaaaatg

SEQ ID NO: 148161 - DNA, 548 bp, Homo sapiens
  Payload ID: 9325
  Gene Symbol: LRRC6
  Gene Name: leucine rich repeat containing 6
  ENST ID: ENST00000522584
  CDS Start-End: 66-335
aagggtgaaaagcgtcattcgaggtccgggtccggcttgcggggtcagcgaactggagaggcgccatgggctggatcacagaagatcttattagacggaatgctgaacacaacgactgtgtcattttttccctggaggaactctcgttgcatcagcaagaaatagaaagactagaacacattgataaatggtgccgggatttaaaaattctctatcttcaaaataatcttattgggaaaattgaaaatgttagcaaactcaagaaacttgaatatttgaatttagctttaaacaacattgaaaaaatagaaaacttggaagatgtcatctattgacttcctgatgtggacgatgcagattttgttctctcacaccatctgcaagctggtctctccatctccacctgtgtcatgaattccaggcaggatgtgaagagctggcaaaacttgacctgactgtgaatttcattggagagctgagcagcattaaaaacttgcagcacaatatccatctgaaggagctctttctcatggggaacccatgtgctt

SEQ ID NO: 148162 - DNA, 1878 bp, Homo sapiens
  Payload ID: 9325
  Gene Symbol: LRRC6
  Gene Name: leucine rich repeat containing 6
  Uniprot ID: Q86X45
  ENST ID: ENST00000620350
  CDS Start-End: 125-1525
agagtccccgttgccatggctcctgaattccgacggggacgcgctgaggagcaggggtgaagggtgaaaagcgtcattcgaggtccgggtccggcttgcggggtcagcgaactggagaggcgccatgggctggatcacagaagatcttattagacggaatgctgaacacaacgactgtgtcattttttccctggaggaactctcgttgcatcagcaagaaatagaaagactagaacacattgataaatggtgccgggatttaaaaattctctatcttcaaaataatcttattgggaaaattgaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagccatttcagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttgaaacatctggctgcgttgccattggctgagacccaccaggtccagttttggttggtgtagagaccatatgcatattattcctgggataaacacagagttatttgtcaatatcgctgctccagtgttttaactcttactttgcatagtaatatccttaagatagcttaaaattaaaatgtatgtcttaaatgctataactcatcatttacctataataaagggttggtattgaaaatgtttagtaagatcatagaactattgcataaaacactgattataaatactgtctacttatgcaaagtattaattcatagataaaaggactgagtattaaattggtacttcagcaaagtg

SEQ ID NO: 148163 - DNA, 1754 bp, Homo sapiens
  Payload ID: 9325
  Gene Symbol: LRRC6
  Gene Name: leucine rich repeat containing 6
  ENST ID: ENST00000618342
  CDS Start-End: 1-1401
atggggacagtcacagaagatcttattagacggaatgctgaacacaacgactgtgtcattttttccctggaggaactctcgttgcatcagcaagaaatagaaagactagaacacattgataaatggtgccgggatttaaaaattctctatcttcaaaataatcttattgggaaaattgaaaatgttagcaaactcaagaaacttgaatatttgaatttagctttaaacaacattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagtggttggatggtaaagaaatagagccttcagaaaggattaaggcattgcaggactattcagtaattgaaccacaaatcagagagcaggaaaaagatcactgtcttaaacgagccaaactcaaggaagaggctcagaggaaacaccaagaagaggataaaaatgaagacaagagaagtaacgcaggctttgatggacgttggtacacagacatcaatgctactctttcctctttagagagcaaagaccacctacaggcaccagacacagaggaacacaacacaaagaaattagacaacagtgaagatgacttggaattctggaataagccctgtttgtttactcctgaatcaagattggaaactcttagacacatggaaaaacaacggaagaaacaggaaaaattaagtgaaaaaaagaagaaagtgaaaccacccaggactttgatcactgaagatgggaaagccctaaatgtgaatgagcccaaaattgacttctctttgaaagataacgaaaagcagatcatcctggaccttgctgtctataggtatatggatacctctttaatcgatgttgatgtgcaaccaacttacgtgcgagtaatgatcaaaggaaagccatttcagcttgtccttcctgcagaagtgaaacccgatagtagttctgctaaaagatctcagacaacgggtcatttggtcatctgcatgcccaaggtaggagaagtaatcacaggtggtcagcgagcattcaaatctatgaaaactacctcggacaggagcagagaacaaacaaatacaagaagcaagcacatggagaaactagaagtagaccctagcaagcactcattccctgatgtgactaacatagttcaagagaaaaaacacacacccagaagacgacctgaacccaaaattataccaagtgaggaagacccaacctttgaagacaaccctgaagtgcctccgctgatttgaaacatctggctgcgttgccattggctgagacccaccaggtccagttttggttggtgtagagaccatatgcatattattcctgggataaacacagagttatttgtcaatatcgctgctccagtgttttaactcttactttgcatagtaatatccttaagatagcttaaaattaaaatgtatgtcttaaatgctataactcatcatttacctataataaagggttggtattgaaaatgtttagtaagatcatagaactattgcataaaacactgattataaatactgtctacttatgcaaagtattaattcatagataaaaggactgagtattaaattggtacttcagcaaagtg

SEQ ID NO: 148164 - DNA, 1684 bp, Homo sapiens
  Payload ID: 9326
  Gene Symbol: LRRC61
  Gene Name: leucine rich repeat containing 61
  Uniprot ID: Q9BV99
  ENST ID: ENST00000323078
  CDS Start-End: 443-1222
gcaggctgcgcttccggaagtaacccctggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccttcgtcttctgaacgtggcctatggcccaggacagcctggcaggtggcctcgctgcccccagttcccctctctgcccccacactcgtcttagttgcttcacactggtcactggccctgcacactgggctattgctttatccctatcctgagagcagcccctccccaccatccctccacatgctgcaaggacagactgaagggctgtgagcaggtgtaagggctcccacatccgtgagcctgtgtccgcagctgctgccactctgggctgctccagcctgcaacttagtggaaggaattacttcctcctgaggctacaggcgagaaaggtagggatgggccagcctcccgtctcagctgttgggagacagtaggcaggctgagtggcccagagcactcctggaagtgggactcccctgccttgcaaatgtgcctctccagactgctcctgcacttaccccctccccgcagcacct

SEQ ID NO: 148165 - DNA, 1877 bp, Homo sapiens
  Payload ID: 9326
  Gene Symbol: LRRC61
  Gene Name: leucine rich repeat containing 61
  Uniprot ID: Q9BV99
  ENST ID: ENST00000359623
  CDS Start-End: 589-1368
ccctggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcagattcatttggattcaaggttggctctcaacagtgccagctgcactgtcatcctaaagtacttctgtggaagagaacatggtggtgtcactgttgtaccagtgatgacacaaaatcccagatctacctgacgggcctgcgagggttgaagattgtgaagcaatagcctaagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccttcgtcttctgaacgtggcctatggcccaggacagcctggcaggtggcctcgctgcccccagttcccctctctgcccccacactcgtcttagttgcttcacactggtcactggccctgcacactgggctattgctttatccctatcctgagagcagcccctccccaccatccctccacatgctgcaaggacagactgaagggctgtgagcaggtgtaagggctcccacatccgtgagcctgtgtccgcagctgctgccactctgggctgctccagcctgcaacttagtggaaggaattacttcctcctgaggctacaggcgagaaaggtagggatgggccagcctcccgtctcagctgttgggagacagtaggcaggctgagtggcccagagcactcctggaagtgggactcccctgccttgcaaatgtgcctctccagactgctcctgcacttaccccctccccgcagcaccttctctgcccgttcttgtccacacatctattaaatgcttctgttttca

SEQ ID NO: 148166 - DNA, 1456 bp, Homo sapiens
  Payload ID: 9326
  Gene Symbol: LRRC61
  Gene Name: leucine rich repeat containing 61
  Uniprot ID: Q9BV99
  ENST ID: ENST00000493307
  CDS Start-End: 646-1425
ggcgcatcccggaatccagagcgcccactacggcctttggccaggccccctgggcgcgttccgggagctcaggcctgcggcgctgggagaagcacgctggccaacaagttgggtggtgggcacgcggcccaggggtcaggggccgccaggcggcgggcggcggggctgcggctcttacctgccgaggaggcgccggctctgcggtgcggagttgcgccggacttcccagcttggccagtggctccgcaggctgccggctccacccctcaggcacaagagaagtagaagagtggccgctttccttctgggcacgcacttgggaaaaggcttgattcatttggattcaaggttggctctcaacagtgccagctgcactgtcatcctaaagtacttctgtggaagagaacatggtggtgtcactgttgtaccagtgatgacacaaaatcccagatctacctgacgggcctgcgagggttgaagattgtgaagcaatagcctaagggactggctggcttcgagcagggcatcggaaccaggcctcctggcactggcctgggtagagccagggcgagcaccagctgacccccagtggaaccctgtgacagtcctgccagggcccaggccatcccaaccgacttccatctcatggaccctccagcggagaagccgggagaggctggcggactgcagatcacaccccagctgctgaagtcacgcacaggcgagttctccctggagtccatcctgctactgaagctgcgtggcttgggactggctgacctgggctgcctgggagagtgcctgggcctggagtggctggacctatcaggcaacgcgctcacccacctgggcccgctggcctccttgcgccagctagctgtgctcaatgtctccaacaatcggctgacgggcctggagccactggccacctgtgagaacttgcagagtctcaatgccgcaggcaacctactggccaccccgggccagctgcagtgtctggctgggctaccgtgcctggagtacctgcggctccgagaccctttggcccggctcagcaacccgctctgtgccaacccctcctactgggctgcagtccgggagctgctgcctggcctgaaagtcatcgacggtgagcgtgtgattgggcgtggtagtgagttctaccagctgtgccgagacctggacagctccttgcgtcccagctccagtccaggccccagagccaccgaggcccagccctgggtggagccaggctactgggagtcctggcccagccggagcagctccatcctggaggaggcctgccggcagttccaggacacactgcaggagtgctgggacctggaccgccaggccagcgacagcctggcccaggcggagcaggtactcagctctgcgggccccacctcttccttcgtcttctgaacgtggcctatggcccaggacagcctggcag

SEQ ID NO: 148167 - DNA, 1864 bp, Homo sapiens
  Payload ID: 9327
  Gene Symbol: LRRC63
  Gene Name: leucine rich repeat containing 63
  Uniprot ID: Q05C16
  ENST ID: ENST00000378805
  CDS Start-End: 346-1864
ggaccccggttgctagggtgtgtctccttggcctcctagagggtggggatccgtggtgcttcttcgggaacagcctcctgcaggaagaccctcgctggacctttacctcgctgcctagattccgaggaaaaggagataggagacgaaaagccagttggtttggaaagcggccgattatcctaaagggtagtgtgggagtccagcacttccatgcccctctttgggtactacggaagggagatttccagcatcgtgtggaacatatgaccagggagtacaccttgagcgcttgtgtgcagttatcttttggcggattatgaaaaacagcacttattattcattaaaatgcaaaagcccccactgcttcttcgaagacccttacctccaaaattcactaagctgtctttacatgagaaaaaaacccatacagctaaaactggtaaaattgagtcactacatgtagcattcactgaagatgaaaccacttccattaaaatggatagaactcgttttcctgatgttttaagaaatcaatcactaacacctatcaatatccaaaatatctttcttgatcactgtgtacaagaaagagtgactgcaatttcatcaccccagaaatctactaagcatgtccgtgagcagattccagatactgctactggttccatattttttccacattgtaattcagcttctactcgaatttttgggaaacaaacaaacaaaatggaaagttcaagaaagtttaaaactatgaaagatgtttatactgaaaaaaggctagaaaacattttaattctttcttccaagttttccaaacctaaaagtactcctggctcagttatcgctcaaaaacttgagaaaatgcaccctaagcatcaacctttaccagagagtccaggctatacttatcagcacatctcgagagacttaagtgcaacagtgccaagccctccacctatgactgtatctatgaaaccagaaggacagtggcctgaacattttaaatcaactgctacattgacactaagagttactgaatttccaggttttgtttccttgccaacaccagttttaccaagaaaacctcacaggcagtctgtgatagaaactcttgtaacagaaaatggaaatatagaaagtgtcccaaagcaaatcccaccaagaccacctgaaggtctcaccaaaactgaaaaaatagaatcagagatacacgttgtacgtggtgaaggttttaagactgttgcagcaacacgatatgaaacaataacagccatgaccaacctggccatagtaaactgtcaagtatatgggagaaatgcacttaatctgaagggcttttttatcctaaattgtccagacttaacacctttggctttccagttgatatatcttaatttatcatttaatgatcttcattactttcccacagaaatattatgtcttaaaaatttacaaatactgaaattgagaaataatcctatcaaagaaattccttctgaaattcaacaacttgagttccttagaattttcaccattgcttttaatttaattactgttcttccaattgggttattttccttgtcttatcttgaagaacttgatgtttcctataatgaacttacttttattccaaatgaaattcagaaactcagatcacttgaaaaactgactgttgatgggaatgaactgagttttttcccccatggaattttgaagcttaacctgacaaaaattcagtttgagaataatttcactcatccttgtttttggagagataattatttgaataatccacaacaacttactcaaattatttctttgttcattgtccaaaataaactacataaattttatgataaga

SEQ ID NO: 148168 - DNA, 2114 bp, Homo sapiens
  Payload ID: 9327
  Gene Symbol: LRRC63
  Gene Name: leucine rich repeat containing 63
  ENST ID: ENST00000446175
  CDS Start-End: 351-2114
ttagcggaccccggttgctagggtgtgtctccttggcctcctagagggtggggatccgtggtgcttcttcgggaacagcctcctgcaggaagaccctcgctggacctttacctcgctgcctagattccgaggaaaaggagataggagacgaaaagccagttggtttggaaagcggccgattatcctaaagggtagtgtgggagtccagcacttccatgcccctctttgggtactacggaagggagatttccagcatcgtgtggaacatatgaccagggagtacaccttgagcgcttgtgtgcagttatcttttggcggattatgaaaaacagcacttattattcattaaaatgcaaaagcccccactgcttcttcgaagacccttacctccaaaattcactaagctgtctttacatgagaaaaaaacccatacagctaaaactggtaaaattgagtcactacatgtagcattcactgaagatgaaaccacttccattaaaatggatagaactcgttttcctgatgttttaagaaatcaatcactaacacctatcaatatccaaaatatctttcttgatcactgtgtacaagaaagagtgactgcaatttcatcaccccagaaatctactaagcatgtccgtgagcagattccagatactgctactggttccatattttttccacattgtaattcagcttctactcgaatttttgggaaacaaacaaacaaaatggaaagttcaagaaagtttaaaactatgaaagatgtttatactgaaaaaaggctagaaaacattttaattctttcttccaagttttccaaacctaaaagtactcctggctcagttatcgctcaaaaacttgagaaaatgcaccctaagcatcaacctttaccagagagtccaggctatacttatcagcacatctcgagagacttaagtgcaacagtgccaagccctccacctatgactgtatctatgaaaccagaaggacagtggcctgaacattttaaatcaactgctacattgacactaagagttactgaatttccaggttttgtttccttgccaacaccagttttaccaagaaaacctcacaggcagtctgtgatagaaactcttgtaacagaaaatggaaatatagaaagtgtcccaaagcaaatcccaccaagaccacctgaaggtctcaccaaaactgaaaaaatagaatcagagatacacgttgtacgtggtgaaggttttaagactgttgcagcaacacgatatgaaacaataacagccatgaccaacctggccatagtaaactgtcaagtatatgggagaaatgcacttaatctgaagggcttttttatcctaaattgtccagacttaacacctttggctttccagttgatatatcttaatttatcatttaatgatcttcattactttcccacagaaatattatgtcttaaaaatttacaaatactgaaattgagaaataatcctatcaaagaaattccttctgaaattcaacaacttgagttccttagaattttcaccattgcttttaatttaattactgttcttccaattgggttattttccttgtcttatcttgaagaacttgatgtttcctataatgaacttacttttattccaaatgaaattcagaaactcagatcacttgaaaaactgactgttgatgggaatgaactgagttttttcccccatggaattttgaagcttaacctgacaaaaattcagtttgagaataatttcactcatccttgtttttggagagataattatttgaataatccacaacaacttactcaaattatttctttgttcattgtccaaaataaactacataaattttatgataagatcccagtagaagttcagaagttactaaaatgcacatccaggtgtgaatggtgtcatggtcccaagtttggtgaaggttttcgtgtcatccgatcctgtgatatttttggagcatcacagcttccagttatgttttatgtctgttctccttcttgctatagaagaataaaggaaagcagttttgttttagatggtagtcctagtagaagaatagctctagatgtggagttgtcaaaagaattatag

SEQ ID NO: 148169 - DNA, 2327 bp, Homo sapiens
  Payload ID: 9327
  Gene Symbol: LRRC63
  Gene Name: leucine rich repeat containing 63
  ENST ID: ENST00000595396
  CDS Start-End: 1-1764
atgcaaaagcccccactgcttcttcgaagacccttacctccaaaattcactaagctgtctttacatgagaaaaaaacccatacagctaaaactggtaaaattgagtcactacatgtagcattcactgaagatgaaaccacttccattaaaatggatagaactcgttttcctgatgttttaagaaatcaatcactaacacctatcaatatccaaaatatctttcttgatcactgtgtacaagaaagagtgactgcaatttcatcaccccagaaatctactaagcatgtccgtgagcagattccagatactgctactggttccatattttttccacattgtaattcagcttctactcgaatttttgggaaacaaacaaacaaaatggaaagttcaagaaagtttaaaactatgaaagatgtttatactgaaaaaaggctagaaaacattttaattctttcttccaagttttccaaacctaaaagtactcctggctcagttatcgctcaaaaacttgagaaaatgcaccctaagcatcaacctttaccagagagtccaggctatacttatcagcacatctcgagagacttaagtgcaacagtgccaagccctccacctatgactgtatctatgaaaccagaaggacagtggcctgaacattttaaatcaactgctacattgacactaagagttactgaatttccaggttttgtttccttgccaacaccagttttaccaagaaaacctcacaggcagtctgtgatagaaactcttgtaacagaaaatggaaatatagaaagtgtcccaaagcaaatcccaccaagaccacctgaaggtctcaccaaaactgaaaaaatagaatcagagatacacgttgtacgtggtgaaggttttaagactgttgcagcaacacgatatgaaacaataacagccatgaccaacctggccatagtaaactgtcaagtatatgggagaaatgcacttaatctgaagggcttttttatcctaaattgtccagacttaacacctttggctttccagttgatatatcttaatttatcatttaatgatcttcattactttcccacagaaatattatgtcttaaaaatttacaaatactgaaattgagaaataatcctatcaaagaaattccttctgaaattcaacaacttgagttccttagaattttcaccattgcttttaatttaattactgttcttccaattgggttattttccttgtcttatcttgaagaacttgatgtttcctataatgaacttacttttattccaaatgaaattcagaaactcagatcacttgaaaaactgactgttgatgggaatgaactgagttttttcccccatggaattttgaagcttaacctgacaaaaattcagtttgagaataatttcactcatccttgtttttggagagataattatttgaataatccacaacaacttactcaaattatttctttgttcattgtccaaaataaactacataaattttatgataagatcccagtagaagttcagaagttactaaaatgcacatccaggtgtgaatggtgtcatggtcccaagtttggtgaaggttttcgtgtcatccgatcctgtgatatttttggagcatcacagcttccagttatgttttatgtctgttctccttcttgctatagaagaataaaggaaagcagttttgttttagatggtagtcctagtagaagaatagctctagatgtggagttgtcaaaagaattatagtacaatgatttatcgtatgtgtgtgtatatatatatatatatatatatttatatatatatatatttatatatatatattcatatatatatataaactttactggcttttactgcatatatatctgcatatagtaattcatctctttgaaagtagaggttctgtttggaagacataagtgtcttctcatacgaattatctttgtaattctagctccttatgaaagtttgtgattgtttgggaattgttgcagaataattactcaaggaggattagtaaagcctttagatttgaataaagctctagaaaatttctttcagagcctgtttactataaaaggaaaaatgttggaatcctttgcaaaatgggttatgtcttacaactggtcttttcatgcatccatactaagtgatgagatagcattgcagagtcatcagtggggtatgtgctgcatagagcttcaatgtcacacatccaagtgctcaatgcttgtgcatttctgtggaaatctgaccagcaccttccatctcaattgtaggttgttttggggaataaaagattaatt

SEQ ID NO: 148170 - DNA, 3327 bp, Homo sapiens
  Payload ID: 9328
  Gene Symbol: LRRC66
  Gene Name: leucine rich repeat containing 66
  Uniprot ID: Q68CR7
  ENST ID: ENST00000343457
  CDS Start-End: 8-2650
aggcattatgaaaaacctctatttcagagtcattaccatagttataggtctttattttactggaataatgacaaatgcatcaagaaaaagcaatattttattcaattctgaatgccaatggaatgaatatattctgacaaattgttcttttaccggaaagtgtgatatacctgtggacatatcacagacagcagccactgtggatgtaagtttcaatttctttagagttctcttacagtctcacacgaaaaaagaagagtggaaaataaaacatctggacctcagtaacaatctcatatcaaaaataaccttaagcccttttgcatatttacatgctttggaagtgttaaacctcagcaacaatgccatccactccctctcattggatctactcagtcctaagtcctcatgggtgaaacgccacagaagcagcttcagaaacaggtttccattgctgaaggtgctcattcttcaaagaaataaactcagtgacactcccaagggactgtggaaactgaagtcattgcagagtttggatctgtcattcaatgggatattgcaaatagggtggtctgattttcacaactgcctgcaactggagaatctctgtttaaagagcaacaagatattcaaaattcccccacaagccttcaaggacctcaaaaaattacaggtcatagaccttagcaacaatgctctgattaccatcctaccaatgatgatcatagctctagaatttccccatctagtggttgacttggctgataataactggcagtgtgatgatagtgtggcagtctttcaaaattttatttctgaatcctggaggaaaaagtggaatgtcatttgcaacaggtctatagggagtgaggaggccaacgggggcactccccagagcaggatttccagggaaacccgccttcctcccattcatctgcatcgcatgaaaagcctcataaggagcaaagcagagaggccccagggaggaaggcacacgggcatttctactctggggaagaaggcaaaggccggctctggtctcaggaagaagcagagacggctgccaaggagtgttagaagcacccgcgatgtgcaggctgccggcaaaaaagaggacgctccccaggacctggctctggcggtgtgcctgtcagtgttcatcacattccttgtcgccttcagcctgggggctttcacaaggccttatgttgacagactgtggcaaaaaaagtgccagagcaaaagccctggcctggacaacgcgtattcaaacgagggcttctacgatgacatggaagctgcggggcacacaccacacccagagacccatctgcgccaagtatttcctcatctaagcctctacgagaaccagacccctttctgggtgacacagccacacccacacgccaccgtaattcctgatagaactctgggaaggagcagaaaggatcctggcagttcgcagagcccaggacagtgcggggacaacaccggggcaggaagtggaaatgatggtgcagtctattccattctccagagacatccacatgccggtaaccgtgaactaatgtcagcagcgcaggaccacatccataggaatgatattctcggagaatggacttatgaaactgtggcccaggaagagcctctcagtgcacattcagtgggcgtctcttctgtagctggcacgtctcacgctgtctctggctcaagccgttatgattccaatgaattagacccttccctctccggagaaataacagcttccctctgtaaaatgctaacacatgcagaagcacagaggactggagatagtaaggaaagagggggcactgaacagtcactttgggactcgcagatggaattttctaaggaaaggcaagtgagttcatccattgatttgctgagcatacagcagccaaggctgtccggggcaagggctgaggaagcgctttcagcccactacagcgaggttccatacggtgacccaagagacacaggcccatcagtctttcctccaagatgggacagtggcctggatgtcactcctgctaacaaggaaccagtgcagaaatccactccttctgacacttgctgtgagttggagagtgactgtgactctgatgaggggtctctgttcactctgagctccataagttcagagagtgcaaggagcaagactgaagaggcagtgcctgatgaggagtccctgcaggacgagagctcaggggcaagcaaggacaatgtgacggctgtagacagtcttgaggaaaatgttaccttccaaacaattccagggaaatgcaagaatcaagaagatccctttgaaaaacctctcatttctgctccagactctggcatgtacaagactcatctggaaaatgcctctgacactgatagatctgagggcctgtcaccctggcccaggtcaccagggaatagtcccttaggggatgagtttccgggcatgttcacttatgattatgacacagctcttcaatccaaggcagcagaatggcattgctcacttagagacttagaattttcaaatgtggacgttttacagcaaacaccaccatgttctgctgaagttccctcagatcctgataaggctgccttccatgaaagagactcagacattttaaaataagaatctttcattaaggaaatattcacagctctaaacaatattcttttaaagatcatggcaggggaaaactaaagccttcacaacaagatcctgaaggagacaacatgaattccaaccaagtggacactgatgcaaatgagggttttgtgggcccacttgagggcgatgattctagaagggttataagctaaacacacttgttaacatcctatggggatgaacctgctcttcagtgtgaaagagaaagaggggaatattttgagatcattccaagaaccatgcaccattattacaagagctccaaacaaaaccagttcactgagaacacaggagcacttcatcaataggttggggtaaatattcagaagagaatctgttgcagttagacgaagtggttctaactttccttctcaaatacagacctggagcaatctgatgggatttggctctctgaaaagaacagctttaggatgacaaagacaaggatgttcaacttgatcatcaaagagaattcaaatgacattttttcatacatattgaagcacttaagtggaaatgctggatagattttaatgaattctgaacacacactagcacaactttttggaggctgatcgtgaaactgcaaaattggaaaagttctgagtaaatataaatgtttttaaataagttatgtt

SEQ ID NO: 148171 - DNA, 720 bp, Homo sapiens
  Payload ID: 9329
  Gene Symbol: LRRC69
  Gene Name: leucine rich repeat containing 69
  Uniprot ID: Q6ZNQ3
  ENST ID: ENST00000343709
  CDS Start-End: 18-593
acttcttttccaagatcatgactgagagattgttaataaaagcattgagtggtggtaaaaatacgaagatcattactttgaatgggaagaagatgacaaagatgccctcagcattaggaaaactgcctggcctgaagactctagtccttcagaataacctaatccccaaagtgtgtccagagttatgcaacttgacccagtttcaggatctgaagctgagggaattctactgtgagggaaacccactgttcctgcagcagccagtgatttctacacagcaggagaacgtctggagtctacaggaaataacatcaagatttgtaatgaatcagctagcagaaaataaccctttcctaatggatgacatagaacggtacccacaagtcaggagcatgatctctcagggaaaaacatgtgcaatatgtggacagtactttataaccgtatggctggaatgtgttcgatttgttcctccaccaaaggactggaagataagcaagaatctgaagctggtgcctctccaagtattaatttgttcttacaaatgttttactcaacgtgaccctaacctctttggaattgctcaggtgtagaacaggtgaggtgctcattcatagcctcactccacttgccctgtcagctctgcatacacagattatgccctacttaagataccatgcctgttctctttgtcaacacattaaataaaggaagaaaaat

SEQ ID NO: 148172 - DNA, 1044 bp, Homo sapiens
  Payload ID: 9329
  Gene Symbol: LRRC69
  Gene Name: leucine rich repeat containing 69
  Uniprot ID: Q6ZNQ3
  ENST ID: ENST00000448384
  CDS Start-End: 1-1044
atgactgagagattgttaataaaagcattgagtggtggtaaaaatacgaagatcattactttgaatgggaagaagatgacaaagatgccctcagcattaggaaaactgcctggcctgaagactctagtccttcagaataacctaatccccaaagtgtgtccagagttatgcaacttgacccagttgacaacactaaatctgggaaacaaccttttagaagaagttccggaagagatgaaatatcttacatctctgaagaatctccatttatctggaaataggatctgtagatttgcacctggagcctgtgatggcttacaaaatttaatcctgcttaatctgaacaacaatcatcttacgcagcttcctcaagaagtcagcagattaaaaagtcttacttatatgagtataaattataaccaactagccagcattcctagagaactttgttttcttgagaatcttgttgaacttcaacttaactacaatcagctgatatgcatacctgaagagattaaattcttgaagaagcttcagaagcttttgctagccagaaacaacattggagttttgccggaggaactttgtgatcttaaaaaactaagaatcctagacatagctggaaatattattcagatatttccatcaggatttcaggatctgaagctgagggaattctactgtgagggaaacccactgttcctgcagcagccagtgatttctacacagcaggagaacgtctggagtctacaggaaataacatcaagatttgtaatgaatcagctagcagaaaataaccctttcctaatggatgacatagaacggtacccacaagtcaggagcatgatctctcagggaaaaacatgtgcaatatgtggacagtactttataaccgtatggctggaatgtgttcgatttgttcctccaccaaaggactggaagataagcaagaatctgaagctggtgcctctccaagtattaatttgttcttacaaatgttttactcaacgtgaccctaacctctttggaattgctcaggtgtag

SEQ ID NO: 148173 - DNA, 571 bp, Homo sapiens
  Payload ID: 9329
  Gene Symbol: LRRC69
  Gene Name: leucine rich repeat containing 69
  ENST ID: ENST00000518304
  CDS Start-End: 420-571
tcagatttaatttttggacaggaacatttcataggtggtgctgctgtgtactttttaattcattacttcataaggcttataatgtgattgtctcaattttattgatgctaaaatgattagtgggttattaacctgatcacttgattataaagttcctcatcaacctttcatctaatactttcagtctccaattatgatttttgcatagctccattattttattagaatttgcaaaaattgtgattattctagttattttgtctttctcatttattagtttcaattcttgtgaataagaactttattaactattaagttatatttaagtgcagtttgtactggaaaagcagaataaatgcttatattttttcctttatcaattttcagactgagttggtgcgctagtaattcccaggatcatgactgagagattgttaataaaagcattgagtggtggtaaaaatacgaagatcattactttgaatgggaagaagatgacaaagatgccctcagcattaggaaaactgcctggcctgaagactctagtccttcagaataacctaatccccaa

SEQ ID NO: 148174 - DNA, 1861 bp, Homo sapiens
  Payload ID: 9329
  Gene Symbol: LRRC69
  Gene Name: leucine rich repeat containing 69
  ENST ID: ENST00000520099
  CDS Start-End: 44-253
gaactctaatggttaccttgttttctacttcttttccaagatcatgactgagagattgttaataaaagcattgagtggtggtaaaaatacgaagatcattactttgaatgggaagaagatgacaaagatgccctcagcattaggaaaactgcctggcctgaagactctagtccttcagaataacctaatccccaaagtgtgtccagagttatgcaacttgacccaggccgggtgcggtggctcatgcctgtaatcccagcactttgggaggctgaggcaggcggatcacttgaaaccaggagttcgagaccagcctggccaacatggcaaaaatcccatctctactaaaaatgcaaaaaaaaaaaaaaaaaaaaaaaaaaaaaaaaaaaaaaaaaaagccaggcgtggtggcacatacctactacttgggaagctgaatgagaatcacttcaacccaggaggcagaggttgcagtgagccgagatcatgccaatgcacgccagcctgggtgacagagtgagactgtctcaaaaggaaaaaaaaattcttctaattatggcttacaaaatttaatcctgcttaatctgaacaacaatcatcttacgcagcttcctcaagaagtcagcagagtctggccctactcacccaggctggagtgcaatggcatgatctcggctcactgcaacctccgccttccaggttcaaatgattctcctgcctcagcctcccgagtagctggtattacaggagtaaaacagaaatttatttctcatagttctggaagttgggaagtgaagaccaaggtgctggcagatgtgatgtctgattaaaaagtcttacttatatgagtataaattataaccaactagccagcattcctagagaactttgttttcttgagaatcttgttgaacttcaacttaactacaatcagctgatatgcatacctgaagagattaaattcttgaagaagcttcagaagcttttgctagccagaaacaacattggagttttgccggaggaactttgtgatcttaaaaaactaagaatcctagacatagctggaaatattattcagatatttccatcaggatttcaggatctgaagctgagggaattctactgtgagggaaacccactgttcctgcagcagccagtgatttctacacagcaggagaacgtctggagtctacaggaaataacatcaagatttgtaatgaatcagctagcagaaaataaccctttcctaatggatgacatagaacggtacccacaagtcaggagcatgatctctcagggaaaaacatgtgcaatatgtggacagtactttataaccgtatggctggaatgtgttcgatttgttcctccaccaaagaaactacaacctaatacaagcaacaacagccagaatttatttggtactgagtgtgcatctggtgctctgctaaatatgtcacctggaatacctcaattaatgtccaaaataaccccatgacaccagtaagaaatccaaggactggaagataagcaagaatctgaagctggtgcctctccaagtattaatttgttcttacaaatgttttactcaacgtgaccctaacctctttggaattgctcaggtgtagaacaggtgaggtgctcattcatagcctcactccacttgccctgtcagctctgcatacacagattatgccctacttaagataccatgcctgttctctttgtcaacacattaaataaaggaagaaaaataattccattataacgttcccaatctaagcactacaatctgccttcagcttgcttagattctaggtgtgctttttttggcttaaaaaagtacaaaaaaaaattgaaaaat

SEQ ID NO: 148175 - DNA, 5000 bp, Homo sapiens
  Payload ID: 9330
  Gene Symbol: LRRC7
  Gene Name: leucine rich repeat containing 7
  Uniprot ID: Q96NW7
  ENST ID: ENST00000035383
  CDS Start-End: 31-4644
ttctgcgtttctctagtgcagtgcctggagatgaccaccaaacggaaaatcatcggccgtctggtgccatgccgatgtttccgaggtgaagaagaaatcatctcagttttagattactcccactgcagtcttcagcaggtgccaaaggaggtctttaacttcgaacgaacattagaggagctttatctagatgccaatcaaattgaagaactacccaagcaattgttcaactgtcaagctctacgaaaactaagtattcctgataacgacctttcaaatctgccaaccactattgctagtttagttaatcttaaagaactcgacatcagtaaaaatggtgtacaagaatttccagaaaacataaagtgctgtaagtgtttaacaattattgaagccagtgtcaatcccatttctaaactacctgatggcttcacacagctcctaaacctgacccagctctacctgaatgacgcctttcttgaatttcttccagccaattttggaagacttgtcaaattgcggatcttggagttaagagaaaatcacttgaaaactctaccaaagtcaatgcacaaactggcccagttggaaagacttgacctaggcaataatgaattcggtgagctgcctgaagttctggatcaaatacaaaatttgagggagttatggatggataataatgcattacaagtgttacctgggtctatagggaagttaaagatgttggtatacctggatatgtcaaaaaacagaatagaaacagttgacatggacatttctggatgtgaagcccttgaggacctcttattgtcatccaatatgttgcaacaattgcctgattctataggacttttgaaaaaactaacaactctaaaagtagatgacaatcaacttacaatgctacccaatacaattggaaatttatctttattagaagaatttgactgtagctgtaatgaactggagtcactaccttctactattggctaccttcatagtcttcggacattagcagttgatgagaatttccttccagaattacccagagaaattggaagttgtaagaatgtaacagtcatgtctctacgctccaacaaattagaatttcttcctgaagagattggacagatgcagaaactaagagtcctaaatttgagtgacaacagattgaagaatttaccattctcatttaccaaacttaaagagcttgcagctttgtggctttctgacaatcagtccaaagcccttatccctttacaaacagaagcccatccagaaacaaagcaaagagtattgactaactacatgtttccccagcagcctcgtggtgatgaagatttccagtcagacagtgacagctttaaccctacactgtgggaagagcagagacaacaacgcatgactgttgcctttgaatttgaagacaaaaaagaagatgacgaaaatgctgggaaagttaaggatctctcctgccaagccccctgggaaaggggccagcgtgggattactctccaacctgccagactgtctggcgattgctgcacaccatgggccaggtgtgatcagcagatccaagatatgcccgtcccccagaatgacccacagctggcatggggttgtataagtggcctccagcaggaaaggagcatgtgtactccattgccagttgcagcacaatccaccactcttccctctctaagtggcagacaggttgaaataaacctaaaacgatatccaactccttacccagaggatttaaagaatatggtaaaatctgttcaaaatttggtgggtaagccaagccatggagtgcgtgttgagaattcaaatccaactgctaacacggagcaaactgtgaaagaaaaatatgaacacaagtggccggtagccccaaaggagattacagtggaggattcttttgttcatccagctaatgaaatgaggattggggaacttcacccttcattagctgagacccctctgtacccacccaaacttgttctgctagggaaggacaaaaaagaatcaactgatgagtctgaagttgacaaaactcactgtctgaataacagtgtttcctcaggcacttactcagactactcgccttcccaggcttcctcaggatcctctaatacccgggttaaagtggggtccttgcagacaacagctaaagatgcagtacataattctttgtggggtaacaggattgcaccatctttcccacagcctcttgattcaaagccattactcagccagcgggaggctgttcccccaggcaatataccacagcgtcctgaccggctgcccatgagtgatactttcactgacaactggactgatggctcgcattatgacaacacagggtttgttgctgaggaaaccacagccgagaatgccaacagtaatcctctcttaagttcgaaatctagaagcacatcttcgcatggacgcaggcctttgatcaggcaagacaggattgttggtgttcccctggaactcgagcagtctacacacagacacacaccagaaacagaagtgcctccttccaatccttggcagaattggaccagaacccctagtccgtttgaagacaggaccgcttttccttccaaattagagacaacccccactaccagcccattgcctgaaaggaaagaacatataaaggaatctactgaaatacctagtcctttttctccaggcgtaccatgggagtatcatgattccaatcccaacaggagtcttagtaatgtcttttctcaaatccactgccgcccggaatcttctaaaggtgttatttcaattagcaaaagcacagagaggctttcccccctaatgaaagatatcaagtctaataaattcaaaaagtcacagagtatcgatgagattgacattggtacatataaggtgtataacataccattagaaaactatgcttctgggagtgatcacttaggaagccacgaacgaccggataagatgctgggaccagagcatggtatgtccagtatgtctcgaagccagtcagtcccaatgctggatgatgagatgctcacctacggaagtagtaaggggccacaacaacaaaaagcttctatgacaaaaaaagtctatcagtttgaccaaagcttcaatcctcaaggatcagtggaagtgaaagccgaaaagaggataccacccccttttcaacacaatcccgagtacgtgcaacaggccagcaaaaacatcgccaaggatttgattagtcctagagcttacagaggatacccaccgatggagcaaatgttttcattttctcagccatctgtgaatgaggatgctgtggtgaatgcccagttcgcaagccaaggggccagggcgggcttcctgagaagggccgactccctggtgagcgccacagaaatggccatgtttagaagggtcaatgagcctcatgagctgcccccaactgataggtacggcagacccccatataggggagggctggatcgccaaagcagcgttacagtgactgagtcccagttcctgaaaaggaatggcaggtatgaagatgaacacccttcatatcaagaagtgaaagctcaggcgggaagttttccggttaaaaaccttacccaaaggaggccattgtctgcgagaagctacagtacagagagttacggtgcctcccaaaccaggccagtttcagctaggcctactatggcagctcttttggaaaaaataccatctgactataacttgggtaactatggtgacaagccatcagataacagtgatttaaagacgaggcctactcctgtgaagggagaggagagctgtggtaaaatgcctgcagactggagacaacagctgcttagacatatagaagctagacggttagacaggaatgctgcttacaaacacaatacagttaaccttggcatgctgccctatggaggtatttcagcaatgcatgcaggcagaagcatgactttaaacttgcagactaagtctaaatttgatcatcaagaactacctcttcagaaaaccccgtcccagcaaagcaacattttagacaatggacaagaagatgtatctcctagtggccaatggaatccttatccacttgggaggcgggatgtacctccggacaccattactaagaaggcaggcagccacatccagacgttgatggggtcccaaagccttcagcatcgcagccgggagcagcagccgtatgaaggaaatataaacaaagtgaccatccagcaatttcagtcaccattgcctattcagatcccctcttcacaggccacccggggacctcagcctggacggtgcttaattcaaactaaagggcaaaggagtatggatggatatccagagcagttttgtgtgagaatagaaaagaatcctggccttggatttagtatcagtggtggaattagtggacaaggaaatccattcaaaccttctgacaagggtatctttgttactagggttcagcctgatgggccagcatcaaacctactgcagcctggtgataagatccttcaggcaaatggacacagttttgtacatatggaacatgaaaaagctgtattactactgaagagtttccagaacacagtagacctagttattcaacgtgagcttactgtctaaatattttttataaatagtgaagatacgtctagccagacctaatgttcaaaaataaatttatacatagaaacaaattttgccaattgctggaccaatggcaaacattagtgccaaatgtataatactatatgttagcactgaccatccttaaaaaatgttaactctataaatatgatgttcatgtggttatgtattagttttaattgtcagcctctggctgtgcattggtgcagttttgtttctgtttttgtttttgtttttaatcaaataagtttcttctcaaaatggatttcatataatttcggagcacggaagcacacacaagctctttatgaattctgctctccatcagaaac

SEQ ID NO: 148176 - DNA, 6507 bp, Homo sapiens
  Payload ID: 9330
  Gene Symbol: LRRC7
  Gene Name: leucine rich repeat containing 7
  ENST ID: ENST00000310961
  CDS Start-End: 419-4906
gcttcccgcgggaacctctccagccgtccacctgaagggcactggcatcatggtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgatggagaacctaataaggggaaggaatcccccgcaataccagagaagtccttgtaaagaggttcgtgcagcacttcggaagaggcctgaagaggagtgagcccgctacatgaaaaaaaatgcaagtcaaagtggtcacaacctagaagtctgcagagacaggaataactagcaatgcagtgcctggagatgaccaccaaacggaaaatcatcggccgtctggtgccatgccgatgtttccgaggtgaagaagaaatcatctcagttttagattactcccactgcagtcttcagcaggtgccaaaggaggtctttaacttcgaacgaacattagaggagctttatctagatgccaatcaaattgaagaactacccaagcaattgttcaactgtcaagctctacgaaaactaagtattcctgataacgacctttcaaatctgccaaccactattgctagtttagttaatcttaaagaactcgacatcagtaaaaatggtgtacaagaatttccagaaaacataaagtgctgtaagtgtttaacaattattgaagccagtgtcaatcccatttctaaactacctgatggcttcacacagctcctaaacctgacccagctctacctgaatgacgcctttcttgaatttcttccagccaattttggaagacttgtcaaattgcggatcttggagttaagagaaaatcacttgaaaactctaccaaagtcaatgcacaaactggcccagttggaaagacttgacctaggcaataatgaattcggtgagctgcctgaagttctggatcaaatacaaaatttgagggagttatggatggataataatgcattacaagtgttacctgggtctatagggaagttaaagatgttggtatacctggatatgtcaaaaaacagaatagaaacagttgacatggacatttctggatgtgaagcccttgaggacctcttattgtcatccaatatgttgcaacaattgcctgattctataggacttttgaaaaaactaacaactctaaaagtagatgacaatcaacttacaatgctacccaatacaattggaaatttatctttattagaagaatttgactgtagctgtaatgaactggagtcactaccttctactattggctaccttcatagtcttcggacattagcagttgatgagaatttccttccagaattacccagagaaattggaagttgtaagaatgtaacagtcatgtctctacgctccaacaaattagaatttcttcctgaagagattggacagatgcagaaactaagagtcctaaatttgagtgacaacagattgaagaatttaccattctcatttaccaaacttaaagagcttgcagctttgtggctttctgacaatcagtccaaagcccttatccctttacaaacagaagcccatccagaaacaaagcaaagagtattgactaactacatgtttccccagcagcctcgtggtgatgaagatttccagtcagacagtgacagctttaaccctacactgtgggaagagcagagacaacaacgcatgactgttgcctttgaatttgaagacaaaaaagaagatgacgaaaatgctgggaaagttaaggatctctcctgccaagccccctgggaaaggggccagcgtgggattactctccaacctgccagactgtctggcgattgctgcacaccatgggccaggtgtgatcagcagatccaagatatgcccgtcccccagaatgacccacagctggcatggggttgtataagtggcctccagcaggaaaggagcatgtgtactccattgccagttgcagcacaatccaccactcttccctctctaagtggcagacaggttgaaataaacctaaaacgatatccaactccttacccagaggatttaaagaatatggtaaaatctgttcaaaatttggtgggtaagccaagccatggagtgcgtgttgagaattcaaatccaactgctaacacggagcaaactgtgaaagaaaaatatgaacacaagtggccggtagccccaaaggagattacagtggaggattcttttgttcatccagctaatgaaatgaggattggggaacttcacccttcattagctgagacccctctgtacccacccaaacttgttctgctagggaaggacaaaaaagaatcaactgatgagtctgaagttgacaaaactcactgtctgaataacagtgtttcctcaggcacttactcagactactcgccttcccaggcttcctcaggatcctctaatacccgggttaaagtggggtccttgcagacaacagctaaagatgcagtacataattctttgtggggtaacaggattgcaccatctttcccacagcctcttgattcaaagccattactcagccagcgggaggctgttcccccaggcaatataccacagcgtcctgaccggctgcccatgagtgatactttcactgacaactggactgatggctcgcattatgacaacacagggtttgttgctgaggaaaccacagccgagaatgccaacagtaatcctctcttaagttcgaaatctagaagcacatcttcgcatggacgcaggcctttgatcaggcaagacaggattgttggtgttcccctggaactcgagcagtctacacacagacacacaccagaaacagaagtgcctccttccaatccttggcagaattggaccagaacccctagtccgtttgaagacaggaccgcttttccttccaaattagagacaacccccactaccagcccattgcctgaaaggaaagaacatataaaggaatctactgaaatacctagtcctttttctccaggcgtaccatgggagtatcatgattccaatcccaacaggagtcttagtaatgtcttttctcaaatccactgccgcccggaatcttctaaaggtgttatttcaattagcaaaagcacagagaggctttcccccctaatgaaagatatcaagtctaataaattcaaaaagtcacagagtatcgatgagattgacattggtacatataaggtgtataacataccattagaaaactatgcttctgggagtgatcacttaggaagccacgaacgaccggataagatgctgggaccagagcatggtatgtccagtatgtctcgaagccagtcagtcccaatgctggatgatgagatgctcacctacggaagtagtaaggggccacaacaacaaaaagcttctatgacaaaaaaagtctatcagtttgaccaaagcttcaatcctcaaggatcagtggaagtgaaagccgaaaagaggataccacccccttttcaacacaatcccgagtacgtgcaacaggccagcaaaaacatcgccaaggatttgattagtcctagagcttacagaggatacccaccgatggagcaaatgttttcattttctcagccatctgtgaatgaggatgctgtggtgaatgcccagttcgcaagccaaggggccagggcgggcttcctgagaagggccgactccctggtgagcgccacagaaatggccatgtttagaagggtcaatgagcctcatgagctgcccccaactgataggtacggcagacccccatataggggagggctggatcgccaaagcagcgttacagtgactgagtcccagttcctgaaaaggaatggcaggtatgaagatgaacacccttcatatcaagaagtgaaagctcaggcgggaagttttccggttaaaaaccttacccaaaggaggccattgtctgcgagaagctacagtacagagagttacggtgcctcccaaaccaggccagtttcagctaggcctactatggcagctcttttggaaaaaataccatctgactataacttgggtaactatggtgacaagccatcagataacagtgatttaaagacgaggcctactcctgtgaagggagaggagagctgtggtaaaatgcctgcagactggagacaacagctgcttagacatatagaagctagacggttagacaggaccccgtcccagcaaagcaacattttagacaatggacaagaagatgtatctcctagtggccaatggaatccttatccacttgggaggcgggatgtacctccggacaccattactaagaaggcaggcagccacatccagacgttgatggggtcccaaagccttcagcatcgcagccgggagcagcagccgtatgaaggaaatataaacaaagtgaccatccagcaatttcagtcaccattgcctattcagatcccctcttcacaggccacccggggacctcagcctggacggtgcttaattcaaactaaagggcaaaggagtatggatggatatccagagcagttttgtgtgagaatagaaaagaatcctggccttggatttagtatcagtggtggaattagtggacaaggaaatccattcaaaccttctgacaagggtatctttgttactagggttcagcctgatgggccagcatcaaacctactgcagcctggtgataagatccttcaggcaaatggacacagttttgtacatatggaacatgaaaaagctgtattactactgaagagtttccagaacacagtagacctagttattcaacgtgagcttactgtctaaatattttttataaatagtgaagatacgtctagccagacctaatgttcaaaaataaatttatacatagaaacaaattttgccaattgctggaccaatggcaaacattagtgccaaatgtataatactatatgttagcactgaccatccttaaaaaatgttaactctataaatatgatgttcatgtggttatgtattagttttaattgtcagcctctggctgtgcattggtgcagttttgtttctgtttttgtttttgtttttaatcaaataagtttcttctcaaaatggatttcatataatttcggagcacggaagcacacacaagctctttatgaattctgctctccatcagaaacactgcctcaaagttgtatatgcctttatatagaaaatacaaatataaagaattgtaattcccataaaatatttctagcacaaggtatatgttggcatatatacaaaaagaatatagagaaaaacaatattttcataaactaaacatctcagatagagaaaaaatatatcttaaaataagactttactatattgaatctttttcaataaaaattacatgataatgccttatgaaagtaactgtacatatggtataaagtgtttatatttggttccatattcatttgctaaattctcatgacacagagtgaaatatttcataaattagccatttatctctgggacccaaataaaaataggatgaactaatttgttcaatgcctttagctaattacaatacatgcagagtttagaaacagactaaaggtcattgtagttaagtctttttcaccacaaatttaagcagtggatgatgggtggcaggaaaggtattgctttatttctttcaagttcatgttgattataaactgtagcccctgtgatttctttacttgtaaatgtggaatttatttgtgtgttgcttaatctaatttgctgctttttaaattatttaaaacgaattttggaaattgataaaatttatcattacgaaagactgctgttagaaagttatggtaggtgattttaaatccttggtatttaaatatgaaacttcaaatataatttctcagagctgtggtctacctgtatcattaatttcaatggctgtttttctgggcagaaatagataaaatactttttttccaaaaacagtttcaaggtatgtaaaatcctgaatgctttttcactgaagagaaagacaagcatggttaatgtagaattatttacttttccattgaaactattttcctgcataaatgatcaaaatttattttataatcctttaaaatacttatctttcatattagtcattaatttaattacaatattaatttgaatttccaggataatttcccggagttggttgcatgcattatctttcataattttacatagttcttttgttatataatgaatttactttacatgctagtgtttcaagtattgtatgaggattttcacaatagtatcactgaatgatgtcaccagagctctgagaataatatttgtaagttaactgttttatggggacattgaaaatattgtatttttgtagggtctattaaaatgagtgtcacttattagaa

SEQ ID NO: 148177 - DNA, 2375 bp, Homo sapiens
  Payload ID: 9330
  Gene Symbol: LRRC7
  Gene Name: leucine rich repeat containing 7
  ENST ID: ENST00000370958
  CDS Start-End: 191-844
gtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgatggagaacctaataaggggaaggaatcccccgcaataccagagaagtccttgtaaagaggttcgtgcagcacttcggaagaggcctgaagaggagttgcagtgcctggagatgaccaccaaacggaaaatcatcggccgtctggtgccatgccgatgtttccgaggtgaagaagaaatcatctcagttttagattactcccactgcagtcttcagcaggtgccaaaggaggtctttaacttcgaacgaacattagaggagctttatctagatgccaatcaaattgaagaactacccaagcaattgttcaactgtcaagctctacgaaaactaagtattcctgataacgacctttcaaatctgccaaccactattgctagtttagttaatcttaaagaactcgacatcagtaaaaatggtgtacaagaatttccagaaaacataaagtgctgtaagtgtttaacaattattgaagccagtgtcaatcccatttctaaactacctgatggcttcacacagctcctaaacctgacccagctctacctgaatgacgcctttcttgaatttcttccagccaattttggaagacttgtcaaattgcggatcttggagttaagagaaaatcacttgaaaactctaccaaacatctgaagatccagagtgtgccccttgcccaatcgcctgagactatacagtgacacctacaacagaggatgtggagggagcagcttttcgggcaccagaaatggcagcatcaggagcatcagcacgaatagactttgtagaggtagttctcccaaactatattatgaaaccaaacatttttggtgcgctacctgctgatgggggctgccttcttactgcctagtatctacaaaatgtttggtctttgttaaagtttaacgatgacatttctgactaatatagagagacctgatttttttccaaatgtgttcagttgccataactttcaatgaatatgaaattttatcagtctcagaaaaacattaatacccatatttttatctaattgatttcactatttgttatgttaaggtgcttttgtgtataatttttgtatatatttttaaatgggatcaaactaagccataatttaaaagtcatcctaatgcagtaaataagataatttctctagtttgttaaattcttcagagaccgaatataattgctcgtttttctgtcatactccctgatgatgttccattgtggacttattttgcaaagttcccagatggcacaagtcaaaatatgaaatgctgatgattgattgattttatgtatcctttcatcttatgtaatttaatgtggaacagttattttgtagctctaaaatacatttgttaattaaccatattggcttttcatgcagttcaatggcttatagcatttcaatttgcatagaaaatgaatctctgtaatgatacttttgctaaataaataacaatcgacataatgggttcatttgcttttaacattttatacatacaatttagaagtaggatatatttcatattgaaattttgaaaagcttgaaattcaacatacaaggtcaccatcttgctgatgcctaatgcagtacagcaaattcattcttcatcccatgttaactcctttttggaacaagtcaaaatacaaataatttacaatgattgtgttggagctattgcttgattaaatacaattcaaaggttctttttataaaacaggtgtgagcaggacacattgcacttacgggcttttcctatttttttggttctatttcattttactgcctaggaaagaaacatttttttgtaaaacctatgctatggaactgaaatgtactttattgaatatttctattctgttttatgaatatcaattatgtgaaatatataaatataaaattgccttagaatgcctaactctttgtataaaacagatatctgaaagtagatgttggttttttgttcaaattgtgtaaatgctgatttttccatgagtacttatgaagatctatatgtaaaaattttaagtctgcttactgtgtttgtaccaccttgttcttagctgtgtatactctatgctaattgacttctgtcattgtcacatatattgcatatgtctctcaaaaattaaaaggtatattgctattctaaaaataaaaaatgtaaattcctga

SEQ ID NO: 148178 - DNA, 3996 bp, Homo sapiens
  Payload ID: 9330
  Gene Symbol: LRRC7
  Gene Name: leucine rich repeat containing 7
  ENST ID: ENST00000415775
  CDS Start-End: 1424-3889
ctagtgcagtgcctggagatgaccaccaaacggaaaatcatcggccgtctggtgccatgccgatgtttccgaggtgaagaagaaatcatctcagttttagattactcccactgcagtcttcagcaggtgccaaaggaggtctttaacttcgaacgaacattagaggagctttatctagatgccaatcaaattgaagaactacccaagcaattgttcaactgtcaagctctacgaaaactaagtattcctgataacgacctttcaaatctgccaaccactattgctagtttagttaatcttaaagaactcgacatcagtaaaaatggtgtacaagaatttccagaaaacataaagtgctgtaagtgtttaacaattattgaagccagtgtcaatcccatttctaaactacctgatggcttcacacagctcctaaacctgacccagctctacctgaatgacgcctttcttgaatttcttccagccaattttggaagacttgtcaaattgcggatcttggagttaagagaaaatcacttgaaaactctaccaaagtcaatgcacaaactggcccagttggaaagacttgacctaggcaataatgaattcggtgagctgcctgaagttctggatcaaatacaaaatttgagggagttatggatggataataatgcattacaagtgttacctgggtctatagggaagttaaagatgttggtatacctggatatgtcaaaaaacagaatagaaacagttgacatggacatttctggatgtgaagcccttgaggacctcttattgtcatccaatatgttgcaacaattgcctgattctataggacttttgaaaaaactaacaactctaaaagtagatgacaatcaacttacaatgctacccaatacaattggaaatttatctttattagaagaatttgactgtagctgtaatgaactggagtcactaccttctactattggctaccttcatagtcttcggacattagcagttgatgagaatttccttccagaattacccagagaaattggaagttgtaagaatgtaacagtcatgtctctacgctccaacaaattagaatttcttcctgaagagattggacagatgcagaaactaagagtcctaaatttgagtgacaacagattgaagaatttaccattctcatttaccaaacttaaagagcttgcagctttgtggctttctgacaatcagtccaaagcccttatccctttacaaacagaagcccatccagaaacaaagcaaagagtattgactaactacatgtttccccagcagcctcgtggtgatgaagatttccagtcagacagtgacagctttaaccctacactgtgggaagagcagagacaacaacgcatgactgttgcctttgaatttgaagacaaaaaagaagatgacgaaaatgctgggaaagttaaggattgcaccatctttcccacagcctcttgattcaaagccattactcagccagcgggaggctgttcccccaggcaatataccacagcgtcctgaccggctgcccatgagtgatactttcactgacaactggactgatggctcgcattatgacaacacagggtttgttgctgaggaaaccacagccgagaatgccaacagtaatcctctcttaagttcgaaatctagaagcacatcttcgcatggacgcaggcctttgatcaggcaagacaggattgttggtgttcccctggaactcgagcagtctacacacagacacacaccagaaacagaagtgcctccttccaatccttggcagaattggaccagaacccctagtccgtttgaagacaggaccgcttttccttccaaattagagacaacccccactaccagcccattgcctgaaaggaaagaacatataaaggaatctactgaaatacctagtcctttttctccaggcgtaccatgggagtatcatgattccaatcccaacaggagtcttagtaatgtcttttctcaaatccactgccgcccggaatcttctaaaggtgttatttcaattagcaaaagcacagagaggctttcccccctaatgaaagatatcaagtctaataaattcaaaaagtcacagagtatcgatgagattgacattggtacatataaggtgtataacataccattagaaaactatgcttctgggagtgatcacttaggaagccacgaacgaccggataagatgctgggaccagagcatggtatgtccagtatgtctcgaagccagtcagtcccaatgctggatgatgagatgctcacctacggaagtagtaaggggccacaacaacaaaaagcttctatgacaaaaaaagtctatcagtttgaccaaagcttcaatcctcaaggatcagtggaagtgaaagccgaaaagaggataccacccccttttcaacacaatcccgagtacgtgcaacaggccagcaaaaacatcgccaaggatttgattagtcctagagcttacagaggatacccaccgatggagcaaatgttttcattttctcagccatctgtgaatgaggatgctgtggtgaatgcccagttcgcaagccaaggggccagggcgggcttcctgagaagggccgactccctggtgagcgccacagaaatggccatgtttagaagggtcaatgagcctcatgagctgcccccaactgataggtacggcagacccccatataggggagggctggatcgccaaagcagcgttacagtgactgagtcccagttcctgaaaaggaatggcaggtatgaagatgaacacccttcatatcaagaagtgaaagctcaggcgggaagttttccggttaaaaaccttacccaaaggaggccattgtctgcgagaagctacagtacagagagttacggtgcctcccaaaccaggccagtttcagctaggcctactatggcagctcttttggaaaaaataccatctgactataacttgggtaactatggtgacaagccatcagataacagtgatttaaagacgaggcctactcctgtgaagggagaggagagctgtggtaaaatgcctgcagactggagacaacagctgcttagacatatagaagctagacggttagacaggaatgctgcttacaaacacaatacagttaaccttggcatgctgccctatggaggtatttcagcaatgcatgcaggcagaagcatgactttaaacttgcagactaagtctaaatttgatcatcaagaactacctcttcagaaaaccccgtcccagcaaagcaacattttagacaatggacaagaagatgtatctcctagtggccaatggaatccttatccacttgggaggcgggatgtacctccggacaccattactaagaaggcaggcagccacatccagacgttgatggggtcccaaagccttcagcatcgcagccgggagcagcagccgtatgaaggaaatataaacaaagtgaccatccagcaatttcagtcaccattgcctattcagatcccctcttcacaggccacccggggacctcagcctggacggtgcttaattcaaactaaagggcaaaggagtatggatggatatccagagcagttttgtgtgagaatagaaaagaatcctggccttggatttagtatcagtggtggaattagtggacaaggaaatccattcaaaccttctgacaagggtatctttgttactagggttcagcctgatgggccagcatcaaacctactgcagcctggtgataagatccttcaggcaaatggacacagttttgtacatatggaacatgaaaaagctgtattactactgaagagtttccagaacacagtagacctagttattcaacgtgagcttactgtctaaatattttttataaatagtgaagatacgtctagccagacctaatgttcaaaaataaatttatacatagaaacaaattttgccaattgctggaccaatggcaaacatta

SEQ ID NO: 148179 - DNA, 775 bp, Homo sapiens
  Payload ID: 9330
  Gene Symbol: LRRC7
  Gene Name: leucine rich repeat containing 7
  ENST ID: ENST00000588515
  CDS Start-End: 1-185
agggtatctttgttactagggttcagcctgatgggccagcatcaaacctactgcagcctggtgataagatccttcaggcaaatggacacagttttgtacatatggaacatgaaaaagctgtattactactgaagagtttccagaacacagtagacctagttattcaacgaaaacatttactgtagctgaatctctgaggcctaaagtatattattcataaactgaaaacatttggagacatttcattgaagaatataacaaaaacattaaatattatgattataaatattaaaataaatatttgttgggcatcaactacatatcaggtactatgagggatgtaatgtggtcccctcagcacagaatctcacagtccagaggaaagatgagagaagttccacatcaaagacagtacaaggcaatgtgaaacttagtgtcattgcgcatcaacttagaaaatgtgaattgattaaaaatatgtgatggattgtgcagcatgcttacatttgaaaatggagattgtgcctttaaatacttaatcaaaggactcctgaccttcaagtaccagtttgggcatattactggagatccaggttgaaagtctttccactcagaggactcttatttggcttgaatgtggaaaaggcatctggttcaggcactgggacaactcttttccaaagaaagacccaaaaatcgtacaaataagtccaaatgaagcatgatgggaaatcagggactaattctgcttggaggacagggaaggctttcaaag

SEQ ID NO: 148180 - DNA, 786 bp, Homo sapiens
  Payload ID: 9330
  Gene Symbol: LRRC7
  Gene Name: leucine rich repeat containing 7
  ENST ID: ENST00000608815
  CDS Start-End: 1-98
acagttttgtacatatggaacatgaaaaagctgtattactactgaagagtttccagaacacagtagacctagttattcaacgaaaacatttactgtagctgaatctctgaggcctaaagtatattattcataaactgaaaacatttggagacatttcattgaagaatataacaaaaacattaaatattatgattataaatattaaaataaatatttgttgggcatcaactacatatcaggtactatgagggatgtaatgtggtcccctcagcacagaatctcacagtccagaggaaagatgagagaagttccacatcaaagacagtacaaggcaatgtgtatctttcccattctgcctgagatcatagctatttggtgtttgtttttcctatgaactttaagctttttgagagagaggatcagacaatacttaacaaaggacttctagacagaagagcctcaggagagaggagtaatcgttcagctcttcttggtttctgccttccctcctgctcttccagatgtcaaaagaagaatttacagtgaaaaataagaaacttagtgtcattgcgcatcaacttagaaaatgtgaattgattaaaaatatgtgatggattgtgcagcatgcttacatttgaaaatggagattgtgcctttaaatacttaatcaaaggactcctgaccttcaagtaccagtttgggcatattactggagatccaggttgaaagtctttccactcagaggactcttatttggcttgaatgtggaaaaggcatctggttcag

SEQ ID NO: 148181 - DNA, 712 bp, Homo sapiens
  Payload ID: 9330
  Gene Symbol: LRRC7
  Gene Name: leucine rich repeat containing 7
  ENST ID: ENST00000609498
  CDS Start-End: 1-110
aggcaaatggacacagttttgtacatatggaacatgaaaaagctgtattactactgaagagtttccagaacacagtagacctagttattcaacgaaaacatttactgtagctgaatctctgaggcctaaagtatattattcataaactgaaaacatttggagacatttcattgaagaatataacaaaaacattaaatattatgattataaatattaaaataaatatttgttgggcatcaactacatatcaggtactatgagggatgtaatgtggtcccctcagcacagaatctcacagtccagaggaaagatgagagaagttccacatcaaagacagtacaaggcaatgtgtatctttcccattctgcctgagatcatagctatttggtgtttgtttttcctatgaactttaagctttttgagagagaggatcagacaatacttaacaaaggacttctagacagaagagcctcaggagagaaacttagtgtcattgcgcatcaacttagaaaatgtgaattgattaaaaatatgtgatggattgtgcagcatgcttacatttgaaaatggagattgtgcctttaaatacttaatcaaaggactcctgaccttcaagtaccagtttgggcatattactggagatccaggttgaaagtctttccactcagaggactcttatttggcttgaatgtggaaaaggcatctggttcag

SEQ ID NO: 148182 - DNA, 792 bp, Homo sapiens
  Payload ID: 9330
  Gene Symbol: LRRC7
  Gene Name: leucine rich repeat containing 7
  ENST ID: ENST00000608744
  CDS Start-End: 1-77
atgaaaaagctgtattactactgaagagtttccagaacacagtagacctagttattcaacgaaaacatttactgtagctgaatctctgaggcctaaagtatattattcataaactgaaaacatttggagacatttcattgaagaatataacaaaaacattaaatattatgattataaatattaaaataaatatttgttgggcatcaactacatatcaggtactatgagggatgtaatgtggtcccctcagcacagaatctcacagtccagaggaaagatgagagaagttccacatcaaagacagtacaaggcaatgtgaaacttagtgtcattgcgcatcaacttagaaaatgtgaattgattaaaaatatgtgatggattgtgcagcatgcttacatttgaaaatggagattgtgcctttaaatacttaatcaaaggactcctgaccttcaagtaccagtttgggcatattactggagatccaggttgaaagtctgttggcagagaaagtatgactctgcttttagccttctgcacaagacaaaatccttctggtgatcctcagtctttccactcagaggactcttatttggcttgaatgtggaaaaggcatctggttcagaaaaaaagttgattacagttgatcctcattattcatgggtgctatatttgcaaacttgcctactcactaaagtttatacccccaaatcaatgtgtggcacttccgaggtcattcataaacaggcacagaggagcaaaaaattggagtcaccccacgggcatgttcccagg

SEQ ID NO: 148183 - DNA, 2249 bp, Homo sapiens
  Payload ID: 9331
  Gene Symbol: LRRC70
  Gene Name: leucine rich repeat containing 70
  Uniprot ID: Q7Z2Q7
  ENST ID: ENST00000334994
  CDS Start-End: 240-2108
acattgactgtaaaggaaccaatgtgaagagtggtgtttcctgagcaaacggtgacttaaaaaaaaaaaaaaaaaagtggtggggtggaggtcagcagtgccacagaacaaactggagttaagaaatgtcgttcttcagatttaaaaagaaaacctttactgaatcagctgagtgttaataatacgaatttccttttcttgccaattctgatctgaacagaaaatccaagaacagggatatgtgtggattacagttttctctgccttgcctacgactgtttctggttgttacctgttatcttttattattactccacaaagaaatacttggatgttcgtctgtttgtcagctctgcactgggagacaaattaactgccgtaacttaggcctttcgagtattcctaagaattttcctgaaagtacagtttttctgtatctgactgggaataatatatcttatataaatgaaagtgaattaacaggacttcattctcttgtagcattgtatttggataattctaacattctgtatgtatatccaaaagcctttgttcaattgaggcatctatattttctatttctaaataataatttcatcaaacgcttagatcctggaatatttaagggacttttaaatcttcgtaatttatatttacagtataatcaggtatcttttgttccgagaggagtatttaatgatctagtttcagttcagtacttaaatctacaaaggaatcgcctcactgtccttgggagtggtacctttgttggtatggttgctcttcggatacttgatttatcaaacaataacattttgaggatatcagaatcaggctttcaacatcttgaaaaccttgcttgtttgtatttaggaagtaataatttaacaaaagtaccatcaaatgcctttgaagtacttaaaagtcttagaagactttctttgtctcataatcctattgaagcaatacagccctttgcatttaaaggacttgccaatctggaatacctcctcctgaaaaattcaagaattaggaatgttactagggatgggtttagtggaattaataatcttaaacatttgatcttaagtcataatgatttagagaatttaaattctgacacattcagtttgttaaagaatttaatttaccttaagttagatagaaacagaataattagcattgataatgatacatttgaaaatatgggagcatctttgaagatccttaatctgtcatttaataatcttacagccttgcatccaagggtccttaagccgttgtcttcattgattcatcttcaggcaaattctaatccttgggaatgtaactgcaaacttttgggccttcgagactggctagcatcttcagccattactctaaacatctattgtcagaatcccccatccatgcgtggcagagcattacgttatattaacattacaaattgtgttacatcttcaataaatgtatccagagcttgggctgttgtaaaatctcctcatattcatcacaagactactgcgctaatgatggcctggcataaagtaaccacaaatggcagtcctctggaaaatactgagactgagaacattactttctgggaacgaattcctacttcacctgctggtagattttttcaagagaatgcctttggtaatccattagagactacagcagtgttacctgtgcaaatacaacttactacttctgttaccttgaacttggaaaaaaacagtgctctaccgaatgatgctgcttcaatgtcagggaaaacatctctaatttgtacacaagaagttgagaagttgaatgaggcttttgacattttgctagcttttttcatcttagcttgtgttttaatcatttttttgatctacaaagttgttcagtttaaacaaaaactaaaggcatcagaaaactcaagggaaaatagacttgaatactacagcttttatcagtcagcaaggtataatgtaactgcctcaatttgtaacacttccccaaattctctagaaagtcctggcttggagcagattcgacttcataaacaaattgttcctgaaaatgaggcacaggtcattctttttgaacattctgctttataactcaactaaatattgtctataagaaacttcagtgccatggacatgatttaaactgaaacctccttatataattatatactttagttggaaatataatgaattatatgaggttagcattattaaaatatgtttttaataatt

SEQ ID NO: 148184 - DNA, 703 bp, Homo sapiens
  Payload ID: 9331
  Gene Symbol: LRRC70
  Gene Name: leucine rich repeat containing 70
  ENST ID: ENST00000491184
  CDS Start-End: 100-315
tttaaaaagaaaacctttactgaatcagctgagtgttaataatacgaatttccttttcttgccaattctgatctgaacagaaaatccaagaacagggatatgtgtggattacagttttctctgccttgcctacgactgtttctggttgttacctgttatcttttattattactccacaaagaaatacttggatgttcgtctgtttgtcagctctgcactgggagacaaattaactgccgtaacttaggcctttcgagtattcctaagaattttcctgaaagtacagtttttctccttgcatccaagggtccttaagccgttgtcttcattgattcatcttcaggcaaattctaatccttgggaatgtaactgcaaacttttgggccttcgagactggctagcatcttcagccattactctaaacatctattgtcagaatcccccatccatgcgtggcagagcattacgttatattaacattacaaattgtgttacatcttcaataaatgtatccagagcttgggctgttgtaaaatctcctcatattcatcacaagactactgcgctaatgatggcctggcataaagtaaccacaaatggcagtcctctggaaaatactgagactgagaacattactttctgggaacgaattcctacttcacctgctggtagattttttcaagagaatgcctttggtaatcca

SEQ ID NO: 148185 - DNA, 1959 bp, Homo sapiens
  Payload ID: 9332
  Gene Symbol: LRRC71
  Gene Name: leucine rich repeat containing 71
  Uniprot ID: Q8N4P6
  ENST ID: ENST00000337428
  CDS Start-End: 155-1834
gcgtaggctacgccaccgcggacgggtcggatccggtccctggacgcggaacagagatcccctgattcagccacccccagactgagccccgtagagtgcgttcttaccttcctgccccgacgaaggtcccagagacgctgcggacaacaccagcatgtcgagcgagcagagcgcgccgggggcctcacccagggccccgcgtccggggacccagaagtcttctggcgcggtgaccaaaaagggagagcgcgcggccaaagagaagccagcgaccgttctgcctcccgtgggggaggaggagcccaaaagccctgaggagtaccagtgctccggggtcctcgagaccgacttcgccgagctctgcacgcggtggggctacacggacttccccaaagttgtcaaccggccccgcccccacccgcccttcgtcccctccgcctctttgtcggaaaaggccaccttagacgatccgcggctgtcggggtcctgcagcctcaatagcctggagagcaaatacgtgttcttccggcccaccatccaggtggagctggagcaggaggacagcaagtcagtgaaggaaatctacatccgcggttggaaggttgaggaacggattctgggtgtcttctctaaatgtctgcccccgcttacccagctacaggccatcaacttgtggaaggtggggctgaccgataagaccctgaccaccttcatcgagctcctgcctctctgttcatccacgctcaggaaggtgtctctggaggggaacccactgccggagcagtcctatcacaagctcatggccttggacagcacgattgcgcacttgtctctgcggaacaataacatcgacgaccgcggggcgcaactcctgggccaggcgctgtccacgctgcacagctgcaaccggaccctcgtctcgctcaacctgggtttcaaccacatcggtgacgagggcgcaggctacatcgcggacggcctccggctgaaccgttccctgctctggctgtccctggcccacaaccgcatccaggacaagggcgccctgaagctggctgaggtcctgcgcgccttcgagctgacacacaccgaagtggtggagcgccgacgcctcctgctggaaaaagggacacaggagcgctcgcgatcgccctcctcctctcgacacggggactccaaaacggaccgtgagaagagtcagatggtagggatcagcaatagtgcattggtggacaagacagacaagacgcagacaatgaaaacccctaagggcctgggcaagaaaaaggagaaatcatgggaattggccaagaaagaggagaagttggggtctgggcagtcacccacacaaggaacccctaagaaggaagatgccacaaaggcaggcaaggggaaggtaaccatccctgaacagaagccaagcagggcaaaagggatcaagatcgggagcagagagaagcgcagcatcctcctggagtccgagctggttgttgaggctactgaggtggtcaaccctctcctggagcctgtggagcaccgagatgggaaagttttcatgcctgggaacaaggtccttttgcacctcaacctcatccggaaccgcatcacagaggtggggctggagggcttcctcgccacggtgcagtatcagatgcagttctccaaggccaagagtgcatccaagggtccagtggggctgctgtggctgtccctggctaaaaattgcttcgccccacaatgtcctgcgtacgccataatccaggagctgatgttgccaagggatcccatcaaggccaaactcagggaggatgaggccatggcattcttcccctagccccctcccacctgcttgcctctaagactcggggctacagaagcacctcctgtccctgtgtggggtgacctccctgggggagatctcagaccaataacaaagtctgttgctatacttttccttga

SEQ ID NO: 148186 - DNA, 454 bp, Homo sapiens
  Payload ID: 9333
  Gene Symbol: LRRC72
  Gene Name: leucine rich repeat containing 72
  ENST ID: ENST00000382124
  CDS Start-End: 74-247
caagtctctcttcggtgccaccggcgggcgaggccggattaatcaccgctgcttcggccgcccatgtgtcctgatgtcctgggacccgaaccccgtgccccgtaccttgcgatgctggcgcctacggagggcatccgaaactgccctacagagcagtcgccgggcagttgaagatcagctaaagatatgtggccacaggagggatgctgatgtctttgagctgttcctttctaaaaagactgggtaggactccaattattttaccacttcctggaatccacagttttctattggagagacaagatactgaaattgattaaaaaaaaaaaaattatggagacaggctgtttgaatcccagctctgtctcttccagctgggtgatcttggggaactgacagaggtcattgatctttctaggtttaaaaaattaaaatacttatggcttcatcataa

SEQ ID NO: 148187 - DNA, 1000 bp, Homo sapiens
  Payload ID: 9333
  Gene Symbol: LRRC72
  Gene Name: leucine rich repeat containing 72
  Uniprot ID: A6NJI9
  ENST ID: ENST00000401542
  CDS Start-End: 58-921
gccaccggcgggcgaggccggattaatcaccgctgcttcggccgcccatgtgtcctgatgtcctgggacccgaaccccgtgccccgtaccttgcgatgctggcgcctacggagggcatccgaaactgccctacagagcagtcgccgggcagttgaagatcagctaaagatatgtggccacaggagggatgctgatgtctttgagctgttcctttctaaaaaggaactgacagaggtcattgatctttctaggtttaaaaaattaaaatacttatggcttcatcataacaagctccatggaataacatttctaactagaaactattgtctgacagaactatatctaaacaacaatgcaatatttgagatagaaggtctgcattatttgccttcattgcatatactcctgctacaccacaatgagctaaccaacattgatgcaacagtgaaggaattaaagggaatgctaaatctgaagatcctaagtctataccaaaatcctttgtgccaatataacctgtatcgtttatatatcatctaccaccttccaggagtggagctgcttgaccgaaatcaagttacagaaaaagaaagaagatcaatgattaccatttttaaccataaaaaggctcatatcgttcaatcaatagcattcggaggaaaagtggatgcttcatgggatcctaaatcaccatttaagcaaaaaccagcccagagagtaccttcagattttgcatttgcaaataatgtagacaaaactgtgcttgatgacccagaagatgctgtttttgtgaggtccatgaagagatcagtgatgactttgacctctatgaactgggacacagttccaacacgagaggaaaggtaccttgaagaggaaggcacagaaacagctcaaatgctcacagttacactgagataagccctggtatttctagatatcttagtggttttcagttgtatattaaacttccctgtgacttagcatattacatacttac

SEQ ID NO: 148188 - DNA, 2121 bp, Homo sapiens
  Payload ID: 9334
  Gene Symbol: LRRC73
  Gene Name: leucine rich repeat containing 73
  Uniprot ID: Q5JTD7
  ENST ID: ENST00000372441
  CDS Start-End: 902-1852
gagggaacagtgccctggattccggcgggggtatggaccttaggaacggggaaggatggaagaatgggcagaagcagcagtaaccgtgcccaacgccatctccacggggcgtgcctccattccgctccccgtcagccctacccactcagccctgccgcctgccgcctgccagttggctgaccccactcccaagggaagagcggcctatcgctcccagctccttgccccgaaccacccagtgtacgcgaacctcgcgggccggcgtggccttggccgggcagggggcggggcgagcgccggtgacgcggccgttgccatgggaactcgccgcccgctcgctctctggagctggagccggagctgccgccagccgcccgcctcaggctctctctgccagccgtgcggccaggcccgcggggtggtcggggggagccgggcggcagagaaggagggagcgggtacggcctcctagccgagaccggtaagccgaagcccttgagccgctcgctgccgctgccgccgccgccgccgcgaccgcgagggacaaggacaagcgccgagcagcgcctgcccaacccccggaacgcgcacccgccccaacgcccagacacggaccgtgcgggccgcccccgccccagcgccgccccacttcagcccggcccgcgccctggacgcctccgcacctctggccggctccggctcagtcccggtagctcttctccgcccccgccgcagcctccgccgcagccgcagcctccgccacagccgccgcctccacccccggccccactccgcccgcgacccctgccggggccccgaccccggccctatccccggccccgcccgcggccccaccaacctccgttccggccccgtacccggaggcccagccgtgggcacgatgctgcccagctccatccagatttcgggggagccgctgtccggcgccgaggtgcgggacatctgccgcggccttcgcgacaacgccgtgcgcctgctctcactgcgcggctgccgcctctgcgaccgcgactttggccgcatctgccgggccctggccggggccacgtccctggcgcagctcaaccttaacctgggcgtcgtgtccagccccagccgcatcaagcagctggctgaggctctgcggaccaaccgctccatccagtccctcttcctgcatgggagccccctgacagatgcggggctggccttgctgaacccagccctggccctccaccctgccctcgtggctctggacctgggggactgcatgctgggtgatgaagccatcaacctcatctgtggcctcctgcccccagatggggccaaatctggcttgaaggagctaacgctgagtgccaaccctggcatcacccctaagggctggagccgccttgccattgccgtggcccacagctcccaggtccgcgtcctcaatctggattacaaccccctgggtgaccatgtggcaggaatgctggctgtagctgtggcctctagtcgtaccctagaggtcctagacttggagggcacagggctcaccaaccagtcagctcagaccctgctggacatggtagaaaattaccccacagctttgcggagcctggtgttggctgagaacagcattagcccagagctgcagcaacagatctgtgacctcctctctgagggagaggaggaggaggaagtggcaggaggggctggcgacacccaggaatgggagagagggcgggagcctgctgcccaccagagaggcagcagctcctggatgtgccccagcgatcccagctctcagatggtgctaatgacgtcaggactaggggacagtctgttggctgagaccgagatgtgactctccactgggcctctgcacaccatttcacttatctatgtcccgagcaccttgccccagatatcagggtcaggccctgggacttgggagggaactggggtcaggggctgcatgggggctctggcagctcctggcagtgtggtgggaaggaagctctggaagctgtgactgagcaacagccttggggggcacttgaacccacggcaatgcctttgaacttggcagctctggctgcaacccgctggctcggaaaagattttatgaactcc

SEQ ID NO: 148189 - DNA, 1647 bp, Homo sapiens
  Payload ID: 9335
  Gene Symbol: LRRC74A
  Gene Name: leucine rich repeat containing 74A
  ENST ID: ENST00000216450
  CDS Start-End: 125-727
gagtcacaaagtcacaggcgggtggggatcctttcaacagggctcccagcaatagagcagtcccactctcccagatgagctggagaagtagctacctctcccagacagagttggggtcaaattcatgcacatccaattcccatcaaagcctactcttcccagggcttgctgggagggaaggataactgcaggctcccctgggatgcccccagatgagattgaaattgagccagtacgacagagcagcgataaaatgctctactgtgaggccgaatccccgccgactgttgaaaaagtgaaaccagcccgggagaattcggaaacagacctggagattgaagatgatgagaaatttttcaccactggacaaaaggagctgtacctggaggcctgcaagctgatgggtgtagtgcctgtctcctacttcattcggaacatggaggagtcctacgtgaacctcaaccaccacggcctgggccccaggggtaccaaggctattgctatagccctggtgtccaacatggctgttaccaaactggagctggaagacaattgcatcatggaggagggcgtcttgagcctggtggagatgctacaagagaactactacctccaggagatggaaatgacttcaaggaagactccgcagcactgctctgccaagccctgtcgaccaattaccaaattaaaaagctggatctcagtcacaaccaattctctgatgtaggaggggagcacctgggccagatgctggccatcaacgtggggctcacgtcactggatctgagctggaataacttccacacaaggggagctgtggccttgtgcaatggtctccggggtaatgtgaccctgacaaagctggatctctccatgaatggctttgggaatgaggtggctctggccctaggggaagtcctccgactcaaccgctgcctggtctacctggatatcggtggcaatgacatcggcaatgaaggggcctccaaaatcagcaaaggactggaatccaatgaaagcctcagagttctgaagcttttcctgaatcccataaatatggatggggctattttacttatcctggctatcaagaggaaccccaaatccaggatggaagagcttgatatttccaacgtgctggtgtccgagcagttcatgaaaacgttggacggagtgtatgccgttcacccgcagctggacgtggtattcaaggcagtacaaggcctctctcccaagaaaaccatcttcttgttgacaaaccccatgaaactgatccagagctatgcagaccaacacaaaatcacgatcgtggacttcttcaagagcttgaaccccactgggacaatgaagatgtctgtggatgagttccagaaagtgatgatagagcaaaacaaggtccccctgaaccagtaccaggtcagggaggtgataaagaagctcgatgagaagacaggcatggtgaacttcagtttcttgaacacgatgaagccatagcaacaagtctggtctagaaagaagtctcggcgagaggagtcctcgcaagtcggatggtggcagggaggagagcaagaggtggctgaaatctcgatggacagatgctgtggcaggggctgggcacaagcaaataaagtctggcttggttctggg

SEQ ID NO: 148190 - DNA, 1648 bp, Homo sapiens
  Payload ID: 9335
  Gene Symbol: LRRC74A
  Gene Name: leucine rich repeat containing 74A
  Uniprot ID: Q0VAA2
  ENST ID: ENST00000393774
  CDS Start-End: 125-1591
gagtcacaaagtcacaggcgggtggggatcctttcaacagggctcccagcaatagagcagtcccactctcccagatgagctggagaagtagctacctctcccagacagagttggggtcaaattcatgcacatccaattcccatcaaagcctactcttcccagggcttgctgggagggaaggataactgcaggctcccctgggatgcccccagatgagattgaaattgagccagtacgacagagcagcgataaaatgctctactgtgaggccgaatccccgccgactgttgaaaaagtgaaaccagcccgggagaattcggaaacagacctggagattgaagatgatgagaaatttttcaccactggacaaaaggagctgtacctggaggcctgcaagctgatgggtgtagtgcctgtctcctacttcattcggaacatggaggagtcctacgtgaacctcaaccaccacggcctgggccccaggggtaccaaggctattgctatagccctggtgtccaacatggctgttaccaaactggagctggaagacaattgcatcatggaggagggcgtcttgagcctggtggagatgctacaagagaactactacctccaggagatgaatatttccaacaatcaccttggtttggagggggccagaatcatctcagatttctttgagagaaacagttcttctatctggagccttgagctttcaggaaatgacttcaaggaagactccgcagcactgctctgccaagccctgtcgaccaattaccaaattaaaaagctggatctcagtcacaaccaattctctgatgtaggaggggagcacctgggccagatgctggccatcaacgtggggctcacgtcactggatctgagctggaataacttccacacaaggggagctgtggccttgtgcaatggtctccggggtaatgtgaccctgacaaagctggatctctccatgaatggctttgggaatgaggtggctctggccctaggggaagtcctccgactcaaccgctgcctggtctacctggatatcggtggcaatgacatcggcaatgaaggggcctccaaaatcagcaaaggactggaatccaatgaaagcctcagagttctgaagcttttcctgaatcccataaatatggatggggctattttacttatcctggctatcaagaggaaccccaaatccaggatggaagagcttgatatttccaacgtgctggtgtccgagcagttcatgaaaacgttggacggagtgtatgccgttcacccgcagctggacgtggtattcaaggcagtacaaggcctctctcccaagaaaaccatcttcttgttgacaaaccccatgaaactgatccagagctatgcagaccaacacaaaatcacgatcgtggacttcttcaagagcttgaaccccactgggacaatgaagatgtctgtggatgagttccagaaagtgatgatagagcaaaacaaggtccccctgaaccagtaccaggtcagggaggtgataaagaagctcgatgagaagacaggcatggtgaacttcagtttcttgaacacgatgaagccatagcaacaagtctggtctagaaagaagtctcggcgagaggagtcctcgcaagtcggatgg

SEQ ID NO: 148191 - DNA, 576 bp, Homo sapiens
  Payload ID: 9335
  Gene Symbol: LRRC74A
  Gene Name: leucine rich repeat containing 74A
  ENST ID: ENST00000555189
  CDS Start-End: 110-576
aggcgggtggggatcctttcaacagggctcccagcaatagagcagtcccactctcccagatgagctggagaagtagctacctctcccagacagagttggggtcaaattcatgcacatccaattcccatcaaagcctactcttcccagggcttgctgggagggaaggataactgcaggctcccctgggatgcccccagatgagattgaaattgagccagtacgacagagcagcgataaaatgctctactgtgaggccgaatccccgccgactgttgaaaaagtgaaaccagcccgggagaattcggaaacagacctggagattgaaggcgagcatgggcatttgggggcagtcagggcagcttctcctcagaaactggagaaatctggtttccaggagctgtcatctcactcctttccagagtctgccctgcggatggcctgtggaggaaatgtggcagaaaggcctgctcgattttgcctggagtcctcctccgggctggcaggggagagcagctgcagcttcccacgcttgtcacctgcctcaggagcagtgccctcacgtcgtcttgttaaaag

SEQ ID NO: 148192 - DNA, 1886 bp, Homo sapiens
  Payload ID: 9335
  Gene Symbol: LRRC74A
  Gene Name: leucine rich repeat containing 74A
  ENST ID: ENST00000484640
  CDS Start-End: 113-235
cacaggcgggtggggatcctttcaacagggctcccagcaatagagcagtcccactctcccagatgagctggagaagtagctacctctcccagacagagttggggtcaaattcatgcacatccaattcccatcaaagcctactcttcccagggcttgctgggagggaaggataactgcaggctcccctgggatgcccccaggtgagggaagttcacagagtttgagacagaggtgaatggacaggtgtgcttcttagggaagcagtcgagaggtggcaagaagttggcagctgccctcaagagggtcctggcaccatggacaatgacaagcctcttcagcctgagacagaagatgagattgaaattgagccagtacgacagagcagcgataaaatgctctactgtgaggccgaatccccgccgactgttgaaaaagtgaaaccagcccgggagaattcggaaacagacctggagattgaagtttccccaagaagggaagcaccgaaagagaacacttgtgaagcaagagaatgacgctggttccatctgacaggatgatgagaaatttttcaccactggacaaaaggagctgtacctggaggcctgcaagctgatgggtgtagtgcctgtctcctacttcattcggaacatggaggagtcctacgtgaacctcaaccaccacggcctgggccccaggggtaccaaggctattgctatagccctggtgtccaacatggctgttaccaaactggagctggaagacaattgcatcatggaggagggcgtcttgagcctggtggagatgctacaagagaactactacctccaggagatgaatatttccaacaatcaccttggtttggagggggccagaatcatctcagatttctttgagagaaacagttcttctatctggagccttgagctttcaggaaatgacttcaaggaagactccgcagcactgctctgccaagccctgtcgaccaattaccaaattaaaaagctggatctcagtcacaaccaattctctgatgtaggaggggagcacctgggccagatgctggccatcaacgtggggctcacgtcactggatctgagctggaataacttccacacaaggggagctgtggccttgtgcaatggtctccgggggaagtcctccgactcaaccgctgcctggtctacctggatatcggtggcaatgacatcggcaatgaaggggcctccaaaatcagcaaaggactggaatccaatgaaagcctcagagttctgaagcttttcctgaatcccataaatatggatggggctattttacttatcctggctatcaagaggaaccccaaatccaggatggaagagcttgatatttccaacgtgctggtgtccgagcagttcatgaaaacgttggacggagtgtatgccgttcacccgcagctggacgtggtattcaaggcagtacaaggcctctctcccaagaaaaccatcttcttgttgacaaaccccatgaaactgatccagagctatgcagaccaacacaaaatcacgatcgtggacttcttcaagagcttgaaccccactgggacaatgaagatgtctgtggatgagttccagaaagtgatgatagagcaaaacaaggtccccctgaaccagtaccaggtcagggaggtgataaagaagctcgatgagaagacaggcatggtgaacttcagtttcttgaacacgatgaagccatagcaacaagtctggtctagaaagaagtctcggcgagaggagtcctcgcaagtcggatggtggcagggaggagagcaagaggtggctgaaatctcgatggacagatgctgtggcaggggctgggcacaagcaaataaagtctggcttggttctggg

SEQ ID NO: 148193 - DNA, 573 bp, Homo sapiens
  Payload ID: 9335
  Gene Symbol: LRRC74A
  Gene Name: leucine rich repeat containing 74A
  ENST ID: ENST00000557453
  CDS Start-End: 115-237
gtcacaggcgggtggggatcctttcaacagggctcccagcaatagagcagtcccactctcccagatgagctggagaagtagctacctctcccagacagagttggggtcaaattcatgcacatccaattcccatcaaagcctactcttcccagggcttgctgggagggaaggataactgcaggctcccctgggatgcccccaggtgagggaagttcacagagtttgagacagaggtgaatggacaggtgtgcttcttagggaagcagtcgagaggtggcaagaagttggcagctgccctcaagagggtcctggcaccatggacaatgacaagcctcttcagcctgagacagaagatgagattgaaattgagccagtacgacagagcagcgataaaatgctctactgtgaggccgaatccccgccgactgttgaaaaagtgaaaccagcccgggagaattcggaaacagacctggagattgaagatgatgagaaatttttcaccactggacaaaaggagctgtacctggaggcctgcaagctgatgggtgtagtgcctgtctcctacttcattcg

SEQ ID NO: 148194 - DNA, 1179 bp, Homo sapiens
  Payload ID: 9336
  Gene Symbol: LRRC74B
  Gene Name: leucine rich repeat containing 74B
  Uniprot ID: Q6ZQY2
  ENST ID: ENST00000442047
  CDS Start-End: 1-1179
atgaggggttcctgtgagaggtctggggaggatgaagagcagaaagaagaggctatggtggcctgtgggcgtctttcaggggtccccgaggccgagcagggtcccgaggccaattgggactccgacctggagacggaaggcaccgatgggcttggagaactggtcagggacacactgtacctgaggtcttgccgggcccatagtgttgtgcccatctcctgctttctgcgccaagggagcgcccaagagctgaacctccggcaccgtggcctggggccccagggcgcccgggctctggcttcctcattgagctccaatccatatgtcaagcggctggaccttcgagacaatgggctctgtggggcaggtgcagaggccctggcaggtgccctgagcaaaagcagcagcatccatgatgtggacctgtcggagaaccagctgggagtggcaggagcccaggccctctgtgccgccctcacagtgaaccaggccatgcggaagatgcagctgtcagggaatggcctggaggagcaggcggcccagcaccttgccgaactcctgctggcccacacagacctgaagtccctggacctgagctacaaccagctgaatgaccaagcaggggagacacttggaccagccctggcagaaaacacaggactcaccgagcttaacgtgagctggaatcacctccggggcccaggagctgtggcatttgccaggggactggaggcaaacatcttccttaaagttctagacatctcatacaatggctttggggatcctggagcctctgcggtgggtgaggctctgaaggccaacaacgtgttggaggaactcaacatgagtaacaaccgcatctctgcgatgggagccctgagcctgggcctgggcctccgggtcaaccagacgctgaggattcttgtagtgtccaggaatcccatgcgaagtgaaggctgctttggtctcctcaagtctgtccaggacaatccagcctctgccctggaactgctggatttctcagatatccaggtgaacgcagagtttgatggccttgctagctcagtgaggggaattcttccagaactctgcataaagactggcgcttgcagagtggagtataaaaaggagttgctgccagtcttcagatcagccctgccagcgtctgtccctaagtga

SEQ ID NO: 148195 - DNA, 2656 bp, Homo sapiens
  Payload ID: 9337
  Gene Symbol: LRRC75A
  Gene Name: leucine rich repeat containing 75A
  Uniprot ID: Q8NAA5
  ENST ID: ENST00000409083
  CDS Start-End: 164-802
gccgacagccgcccgcccgcccgcccccgcgacgcccgcgcgcaacagttcccccaaagttgcagcccgggaggcgagcgcgcacgggcggccgaggggcgggcggttggcggggacgcggcctcgcggcccagagcggagagtcccggcgggcggcggcggcatgggcacccggcagaccaagggcagcctggcggagagagccagccccggcgccgcgccgggcccccgacgcgaacggccggacttctgggcgtcgctgctgctgcgcgccggggacaaggcggggcgcgcgggcgcggggatgcccccctaccaccggcgagtcggcatggtccaggagctgctgcggatggtgcgccagggccggcgggaggaggcggggacgctgctgcagcacctgcgccaggacctgggcatggagtcgacctcgctagacgacgttctgtatcgctacgccagcttccggaacctggtggaccccatcacacacgacctcatcatcagcctggcacgctacatccactgtcccaagccgcctcaaggctgtcctggccggaagccccccagacaacacagtggacctgtcgggaatcccactgacctcccgagacctggagcgggtgaccagctacctacagcgctgtggggagcaggtagacagcgtggagctgggcttcacaggcctcacggacgacatggtcctgcagctgctgccagcactcagcaccctgccccgcctcaccacactggcactcaatggcaaccggttgacccgggccgtgctgcgcgacctcactgacatccttaaggatcccagcaagttccccaatgtcacgtggattgacctgggcaacaacgtggacatcttctccttgccccagcccttcctgctcagcctgcgcaagcgctccccaaagcagggccacctacccaccatcctggagctgggtgagggcccaggcagtggggaggaggtccgggaagggacagtaggccaggaggaccctggagggggccctgtggcacctgccgaagaccaccatgagggcaaggagactgtagctgcagctcagacgtgacatggaagtgaagggcctcaccagggagtccttgttgggtagaatgggcaaggcaggcaggggagggcgcttctcctatcaggtgggttaaggatattgccaaaaattggcctgggccacccacctacagaaaggcaaaccatatcatctggggaaggggatttgtgttaaaacttcccgttggtcctctgcatctgccccctatcccattatctgccatttggttcttaagtcatcccaggccccagagaaccctctcagctcagctcatggccttccccaaagacttgtggaaatgggcacatggctggaggtactgtaagcctgagccattgtgaacaccaagagctttcccccagaaaaagaatacagtagggcccctacatgtactgcattacatttttcatttaggggaacaagctccaaccagaggaatgtgtccccactcaaggaaggtgggaatctttagcaaaattcctgtaactcctggttgcccgagaccccagttccatctatgctaggggtggactgaacgtggcctacctccttatggagacccagccctatttctgaggcccaccttgattctaggcatctgcccataggaccagctatcgctatatcctttgacagagcagcctacgatgccatgtggtagtgctcaggacagacatggtgcccatgcatacaggcataaagtcctgttcagaaatcccctatccaccttccctacccactgctggctgaaaaactaccagacttctatgtgggctctgatgtccttagcatgcagggtaagtgacaaacctggcttccttcttgtcacttgccagtatgacttcactgacctagacaggccgtaagaactctttccccataactcttaagtaatccaccaacacattccagaaaaccgactgcagaaggtgggctttaaaaccttaaaaacctaggacaatgaaggagtccaatcccttggcagatccaacaagatggctggggagagggagaaacaaactggaggctcccaaaggaacctaacttagcaaaggttctcatcttataccctccccttacccaaatactgtcctactgaaagggccctaccagttaagggatctcttctaaataacaggcaacccctagatccaagtagttcagtccaggaagactgggagccaatcactcttgaaccttgtgggcaaacagtatgggggaggaccctcttgacaggccttggtaggcaagattccaacacaggaagacagcaagatggggcctagagtatggggccctacatgctgttaaggttgtggttaggaatggtgcaatgctgcaggagctggaacaaagctacaccaaggaacagagcacagagcagcaggggccgaaattgaggaggccttaaatgctttgagcttttgccttcagtctaaagctgtagaatagggggttaagagcttaggctgaccacagggaagtttacaagctagagcgaatatctggactgctaatatctgacaacagtaggcgaaatttactttttcttcaaatacacattttcaagaattgac

SEQ ID NO: 148196 - DNA, 1390 bp, Homo sapiens
  Payload ID: 9337
  Gene Symbol: LRRC75A
  Gene Name: leucine rich repeat containing 75A
  Uniprot ID: Q8NAA5
  ENST ID: ENST00000470794
  CDS Start-End: 29-1063
gcggagagtcccggcgggcggcggcggcatgggcacccggcagaccaagggcagcctggcggagagagccagccccggcgccgcgccgggcccccgacgcgaacggccggacttctgggcgtcgctgctgctgcgcgccggggacaaggcggggcgcgcgggcgcggggatgcccccctaccaccggcgagtcggcatggtccaggagctgctgcggatggtgcgccagggccggcgggaggaggcggggacgctgctgcagcacctgcgccaggacctgggcatggagtcgacctcgctagacgacgttctgtatcgctacgccagcttccggaacctggtggaccccatcacacacgacctcatcatcagcctggcacgctacatccactgtcccaagccggaaggcgatgcactgggcgccatggagaagctgtgccggcagctgacataccacctcagcccccactcccagtggaggcggcaccgggggctggtgaaaaggaagccacaggcctgcctcaaggctgtcctggccggaagccccccagacaacacagtggacctgtcgggaatcccactgacctcccgagacctggagcgggtgaccagctacctacagcgctgtggggagcaggtagacagcgtggagctgggcttcacaggcctcacggacgacatggtcctgcagctgctgccagcactcagcaccctgccccgcctcaccacactggcactcaatggcaaccggttgacccgggccgtgctgcgcgacctcactgacatccttaaggatcccagcaagttccccaatgtcacgtggattgacctgggcaacaacgtggacatcttctccttgccccagcccttcctgctcagcctgcgcaagcgctccccaaagcagggccacctacccaccatcctggagctgggtgagggcccaggcagtggggaggaggtccgggaagggacagtaggccaggaggaccctggagggggccctgtggcacctgccgaagaccaccatgagggcaaggagactgtagctgcagctcagacgtgacatggaagtgaagggcctcaccagggagtccttgttgggtagaatgggcaaggcaggcaggggagggcgcttctcctatcaggtgggttaaggatattgccaaaaattggcctgggccacccacctacagaaaggcaaaccatatcatctggggaaggggatttgtgttaaaacttcccgttggtcctctgcatctgccccctatcccattatctgccatttggttcttaagtcatcccaggccccagagaaccctctcagctcagctcatggccttccccaaagacttgtggaaatgggcacatggctggaggtactgtaagcctg

SEQ ID NO: 148197 - DNA, 1238 bp, Homo sapiens
  Payload ID: 9338
  Gene Symbol: LRRC75B
  Gene Name: leucine rich repeat containing 75B
  Uniprot ID: Q2VPJ9
  ENST ID: ENST00000318753
  CDS Start-End: 25-972
ttcggcgaccatcgcgcggcggccatgggggcgcggctgggccggcgggccgggcccgaggctggctctgaggccggggcggcggccggctgcgggcccgcgccctacgagcgccgggtgcggtggctccgcgagatccagtccacgctccgcgagcggcggccggagcgcgcccggcagctgctgcgcctcctgcgccaggacctgggccttgagaggaccctccttcctgatatcctctacagagatgtggccttcctcaacccggtcgaccccatctcccatgacctgcttgtgaacctggcccgggacctgcagtgccccaagaaggactatgagctctggaagtcctcggacaagatctgccgacagctcatctaccacctcacccctcactcgaagcagcagcaagggtccagcctgcgccagaggaagacccagagctgcctcaagagcagcctccagaagactctgctggcaggggagactgtggacctctcaggcatcccgctgtcgacacaggacgtgcaacacatcacacgctacctgagcagccatggtgctgtgctggcggtgctggacctgagcttcacggggctgagtgatgagctgctgcacctcctgctgcccagcctgtgggcgctgccccgcctcacccagctcctgctcaacggcaaccgactgacgcgggccactgcccgcaagctcactgatgccatcaaggacaccaccaagttccctgctttggcttgggtggacctgggcaacaacgtggatgtggcttccctgccccagcccctgctggtcggcctgcgccggcggctgagccagcgcacctcactccccaccatctacgagggcctggaccttgagcctgagggcagtgcggccggggccaccacccctgcctccacctgggactccacagctgctgggctgggacccgagccccaggcctgctgtgccaggtgacccaccacccacctggctcattgctactgacttgtgatgctctcaagcacatgatagtgggcgatgaaggtcaaggaggactcacaggcccccagaaatccagtgtaaatgctcagcctgagattaaggggacagaagaatggactcataggtggccaggtggccagccctggctagaggctcagccttccctcagtgggaggggccccagcacccacagtgtggaccccgcaataaagagtgacacccgcctctgcttttctgca

SEQ ID NO: 148198 - DNA, 1417 bp, Homo sapiens
  Payload ID: 9338
  Gene Symbol: LRRC75B
  Gene Name: leucine rich repeat containing 75B
  ENST ID: ENST00000404045
  CDS Start-End: 26-250
gttcggcgaccatcgcgcggcggccatgggggcgcggctgggccggcgggccgggcccgaggctggctctgaggccggggcggcggccggctgcgggcccgcgccctacgagcgccgggtgcggtggctccgcgagatccagtccacgctccgcgagcggcggccggagcgcgcccggcagctgctgcgcctcctgcgccaggatccgggagacagtggaccctggagagaggacccagggctggtctagggatgcagcctcaccccaagacaccatggcagcccacagagagccatccatgcatcaccagttctccaacaggcggctcatgcccttagagtacacatccccagcatctgtgcatcacaacactcggtccggtggtggctctgctcctacacacaccaggacctgggccttgagaggaccctccttcctgatatcctctacagagatgtggccttcctcaacccggtcgaccccatctcccatgacctgcttgtgaacctggcccgggacctgcagtgccccaagaaggactatgagctctggaagtcctcggacaagatctgccgacagctcatctaccacctcacccctcactcgaagcagcagcaagggtccagcctgcgccagaggaagacccagagctgcctcaagagcagcctccagaagactctgctggcaggggagactgtggacctctcaggcatcccgctgtcgacacaggacgtgcaacacatcacacgctacctgagcagccatggtgctgtgctggcggtgctggacctgagcttcacggggctgagtgatgagctgctgcacctcctgctgcccagcctgtgggcgctgccccgcctcacccagctcctgctcaacggcaaccgactgacgcgggccactgcccgcaagctcactgatgccatcaaggacaccaccaagttccctgctttggcttgggtggacctgggcaacaacgtggatgtggcttccctgccccagcccctgctggtcggcctgcgccggcggctgagccagcgcacctcactccccaccatctacgagggcctggaccttgagcctgagggcagtgcggccggggccaccacccctgcctccacctgggactccacagctgctgggctgggacccgagccccaggcctgctgtgccaggtgacccaccacccacctggctcattgctactgacttgtgatgctctcaagcacatgatagtgggcgatgaaggtcaaggaggactcacaggcccccagaaatccagtgtaaatgctcagcctgagattaaggggacagaagaatggactcataggtggccaggtggccagccctggctagaggctcagccttccctcagtgggaggggccccagcacccacagtgtggaccccgcaataa

SEQ ID NO: 148199 - DNA, 1828 bp, Homo sapiens
  Payload ID: 9338
  Gene Symbol: LRRC75B
  Gene Name: leucine rich repeat containing 75B
  ENST ID: ENST00000446942
  CDS Start-End: 28-354
gggttcggcgaccatcgcgcggcggccatgggggcgcggctgggccggcgggccgggcccgaggctggctctgaggccggggcggcggccggctgcgggcccgcgccctacgagcgccgggtgcggtggctccgcgagatccagtccacgctccgcgagcggcggccggagcgcgcccggcagctgctgcgcctcctgcgccaggacctgggccttgagaggaccctccttcctgatatcctctacagagatgtggccttcctcaacccggtcgaccccatctcccatgacctgcttgtgaacctggcccgggacctgcagtgccccaagaagctgcccagaaccccatgctgacagcacctgcagatgtcctgccatgagcatcgacacagccccaggatgtgtggctgtgaccagccaccggacccagactcctagtcacagtgagtccccaaccaaaaccagggtatccgctctgggccctgccagctctgaatgcccaggtctctgcacagtcggcccctaggactctgcgcctagcccacggccatcacaggaacagccagggcttgcagctgctgtgtgtgctgcctgctcctggggctgctcacagagggactggataaaggatgcagtggagcatgctcagtgccagctttgtgggccgcgcacctcggattccaccctgagctgggcctctgccggagcccagttaggactgagagagagccaggtggtggtgctgtaaaacattacatcccccagccctgtcagcccagacccagaccccgcaggcgcagtctcgcttggagagtgagaggaagaagaacacgctgacctggcttgttcctactccctgggattggcgtcagtggagcacggctccctcgaggggcctggtctggcctcctccccctgtggactatgagctctggaagtcctcggacaagatctgccgacagctcatctaccacctcacccctcactcgaagcagcagcaagggtccagcctgcgccagaggaagacccagagctgcctcaagagcagcctccagaagactctgctggcaggggagactgtggacctctcaggcatcccgctgtcgacacaggacgtgcaacacatcacacgctacctgagcagccatggtgctgtgctggcggtgctggacctgagcttcacggggctgagtgatgagctgctgcacctcctgctgcccagcctgtgggcgctgccccgcctcacccagctcctgctcaacggcaaccgactgacgcgggccactgcccgcaagctcactgatgccatcaaggacaccaccaagttccctgctttggcttgggtggacctgggcaacaacgtggatgtggcttccctgccccagcccctgctggtcggcctgcgccggcggctgagccagcgcacctcactccccaccatctacgagggcctggaccttgagcctgagggcagtgcggccggggccaccacccctgcctccacctgggactccacagctgctgggctgggacccgagccccaggcctgctgtgccaggtgacccaccacccacctggctcattgctactgacttgtgatgctctcaagcacatgatagtgggcgatgaaggtcaaggaggactcacaggcccccagaaatccagtgtaaatgctcagcctgagattaaggggacagaagaatggactcataggtggccaggtggccagccctggctagaggctcagccttccctcagtgggaggggccccagcacccacagtgtggaccccgcaataaagagtgacacccgcctctgcttttctgca

SEQ ID NO: 148200 - DNA, 4619 bp, Homo sapiens
  Payload ID: 9339
  Gene Symbol: LRRC8A
  Gene Name: leucine rich repeat containing 8 family, member A
  Uniprot ID: Q8IWT6
  ENST ID: ENST00000259324
  CDS Start-End: 524-2956
gtgcttcagaaaccaggagtttccgcctcggctcccccatgtccccttgtcatcccctgggtccccccagatcctcacccctccacacacactctcccgttcctagaggttccacctctgggctctctccttgccatttctttttcaaagatttccttagctgtcttctcctgagttcctggtccccttctcttcccttgcacccctccttcctatcgttccgatgggggcagtgccctgacttgggggcaggatccccggctaggctcttggggcctttctgggatgggatatttgggaagaccggtccggaatctaagaacccagaccctgtcccagtcctgtgcattcaggtgggcccgagggcgaggcgagatccagtgaggtccaggcctggtgcagccctagggaggcagcgtccatggagcaaaaggaatgccaggatcctgcacaggcagacgcgggccagcctcagcaccgacagccgacgcgcagatagcagagccatccttggggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgtgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccctgtcaccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataac

SEQ ID NO: 148201 - DNA, 4161 bp, Homo sapiens
  Payload ID: 9339
  Gene Symbol: LRRC8A
  Gene Name: leucine rich repeat containing 8 family, member A
  Uniprot ID: Q8IWT6
  ENST ID: ENST00000372599
  CDS Start-End: 64-2496
cggagcggccggggcctggggctgcctgccgggcggccgggcgcggcgagcccaggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgtgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccctgtcaccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacag

SEQ ID NO: 148202 - DNA, 4355 bp, Homo sapiens
  Payload ID: 9339
  Gene Symbol: LRRC8A
  Gene Name: leucine rich repeat containing 8 family, member A
  Uniprot ID: Q8IWT6
  ENST ID: ENST00000372600
  CDS Start-End: 255-2687
acttccggggcggaggaggctgagtggtgcagtgagggacaaacaaaaggaggcgccggagcagcgctgcggccggcggcgggacggagcggccggggcctggggctgcctgccgggcggccgggcgcggcgagcccagggaggcagcgtccatggagcaaaaggaatgccaggatcctgcacaggcagacgcgggccagcctcagcaccgacagccgacgcgcagatagcagagccatccttggggttgaaccatgattccggtgacagagctccgctactttgcggacacgcagccagcataccggatcctgaagccgtggtgggatgtgttcacagactacatctctatcgtcatgctgatgattgccgtcttcggggggacgctgcaggtcacccaagacaagatgatctgcctgccttgtaagtgggtcaccaaggactcctgcaatgattcgttccggggctgggcagcccctggcccggagcccacctaccccaactccaccattctgccgacccctgacacgggccccacaggcatcaagtatgacctggaccggcaccagtacaactacgtggacgctgtgtgctatgagaaccgactgcactggtttgccaagtacttcccctacctggtgcttctgcacacgctcatcttcctggcctgcagcaacttctggttcaaattcccgcgcaccagctcgaagctggagcactttgtgtctatcctgctgaagtgcttcgactcgccctggaccacgagggccctgtcggagacagtggtggaggagagcgaccccaagccggccttcagcaagatgaatgggtccatggacaaaaagtcatcgaccgtcagtgaggacgtggaggccaccgtgcccatgctgcagcggaccaagtcacggatcgagcagggtatcgtggaccgctcagagacgggcgtgctggacaagaaggagggggagcaagccaaggcgctgtttgagaaggtgaagaagttccggacccatgtggaggagggggacattgtgtaccgcctctacatgcggcagaccatcatcaaggtgatcaagttcatcctcatcatctgctacaccgtctactacgtgcacaacatcaagttcgacgtggactgcaccgtggacattgagagcctgacgggctaccgcacctaccgctgtgcccaccccctggccacactcttcaagatcctggcgtccttctacatcagcctagtcatcttctacggcctcatctgcatgtatacactgtggtggatgctacggcgctccctcaagaagtactcgtttgagtcgatccgtgaggagagcagctacagcgacatccccgacgtcaagaacgacttcgccttcatgctgcacctcattgaccaatacgacccgctctactccaagcgcttcgccgtcttcctgtcggaggtgagtgagaacaagctgcggcagctgaacctcaacaacgagtggacgctggacaagctccggcagcggctcaccaagaacgcgcaggacaagctggagctgcacctgttcatgctcagtggcatccctgacactgtgtttgacctggtggagctggaggtcctcaagctggagctgatccccgacgtgaccatcccgcccagcattgcccagctcacgggcctcaaggagctgtggctctaccacacagcggccaagattgaagcgcccgcgctggccttcctgcgtgagaacctgcgggcgctgcacatcaagttcaccgacatcaaggagatcccgctgtggatctatagcctgaagacactggaggagctgcacctgacgggcaacctgagcgcggagaacaaccgctacatcgtcatcgacgggctgcgggagctcaaacgcctcaaggtgctgcggctcaagagcaacctaagcaagctgccacaggtggtcacagatgtgggcgtgcacctgcagaagctgtccatcaacaatgagggcaccaagctcatcgtcctcaacagcctcaagaagatggcgaacctgactgagctggagctgatccgctgtgacctggagcgcatcccccactccatcttcagcctccacaacctgcaggagattgacctcaaggacaacaacctcaagaccatcgaggagatcatcagcttccagcacctgcaccgcctcacctgccttaagctgtggtacaaccacatcgcctacatccccatccagatcggcaacctcaccaacctggagcgcctctacctgaaccgcaacaagatcgagaagatccccacccagctcttctactgccgcaagctgcgctacctggacctcagccacaacaacctgaccttcctccctgccgacatcggcctcctgcagaacctccagaacctagccatcacggccaaccggatcgagacgctccctccggagctcttccagtgccggaagctgcgggccctgcacctgggcaacaacgtgctgcagtcactgccctccagggtgggcgagctgaccaacctgacgcagatcgagctgcggggcaaccggctggagtgcctgcctgtggagctgggcgagtgcccactgctcaagcgcagcggcttggtggtggaggaggacctgttcaacacactgccacccgaggtgaaggagcggctgtggagggctgacaaggagcaggcctgagcgaggccggcccagcacagcaagcagcaggaccgctgcccagtcctcaggcccggaggggcaggcctagcttctcccagaactcccggacagccaggacagcctcgtggctgggcaggagcctggggccgcttgtgagtcaggccagagcgagaggacagtatctgtggggctggccccttttctccctctgagactcacgtcccccagggcaagtgcttgtggaggagagcaagtctcaagagcgcagtatttggataatcagggtctcctccctggaggccagctctgccccaggggctgagctgccaccagaggtcctgggaccctcactttagttcttggtatttatttttctccatctcccacctccttcatccagataacttatacattcccaagaaagttcagcccagatggaaggtgttcagggaaaggtgggctgccttttccccttgtccttatttagcgatgccgccgggcatttaacacccacctggacttcagcagagtggtccggggcgaaccagccatgggacggtcacccagcagtgccgggctgggctctgcggtgcggtccacgggagagcaggcctccagctggaaaggccaggcctggagcttgcctcttcagtatttgtggcagttttagttttttgtttttttttttttaatcaaaaaacaatttttttaaaaaaaaagctttgaaaatggatggtttgggtattaaaaagaaaaaaaaaacttaaaaaaaaaaagacactaacggccagtgagttggagtctcagggcagggtggcagtttcccttgagcaaagcagccagacgttgaactgtgtttcctttccctgggcgcagggtgcagggtgtcttccggatctggtgtgaccttggtccaggagttctatttgttcctggggagggaggtttttttgtttgttttttgggtttttttggtgtcttgttttctttctcctccatgtgtcttggcaggcactcatttctgtggctgtcggccagagggaatgttctggagctgccaaggagggaggagactcgggttggctaatccccggatgaacggtgctccattcgcacctcccctcctcgtgcctgccctgcctctccacgcacagtgttaaggagccaagaggagccacttcgcccagactttgtttccccaccgcctgcggcatgggtgtgtccagtgccaccgctggcctccgctgcttccatcagccctgtcaccacctggtccttcatgaagagcagacacttagaggctggtcgggaatggggaggtcgcccctgggagggcaggcgttggttccaagccggttcccgtccctggcgcctggagtgcacacagcccagtcggcacctggtggctggaagccaccctgctttagatcactcgggtccccaccttagaagggtccccgccttagatcaatcacgtggacactaaggcacgttttagagtctcttgtcttaatgattatgtccatccgtctgtccgtccatttgtgttttctgcgtcgtgtcattggatataatcctcagaaataatgcacactagcctctgacaaccatgaagcaaaaatccgttacatgtgggtctgaacttgtagactcggtcacagtatcaaataaaatctataacagaaa

SEQ ID NO: 148203 - DNA, 7593 bp, Homo sapiens
  Payload ID: 9340
  Gene Symbol: LRRC8B
  Gene Name: leucine rich repeat containing 8 family, member B
  Uniprot ID: Q6P9F7
  ENST ID: ENST00000330947
  CDS Start-End: 361-2772
gctgagcccgcagcctccggcagccgggaaagtgcgggcgcggggccgcagcctgcccgcccggagcggcccaggagcacgccgcggggagcgcgggcgtccggggctggagtcgcgcaggtaatagttaacctcttctgtgagaagtcagaaggtgatctctttaatgctttctttttaagaatttttcaaattgagactaattgcagaggttccagttgaccagcattcataggaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgcccagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaatgacctccaccgacagcagtactcctatattgatgccgtctgttacgagaaacagctccattggtttgcaaagtttttcccctatctggtgctcttgcacacgctcatctttgcagcctgcagcaacttttggcttcactaccccagtaccagttccaggctcgagcattttgtggccatccttcacaagtgcttcgattctccatggaccacccgcgccctttcagaaacagtggctgagcagtcagtgaggcctctgaaactctccaagtccaagattttgctttcgtcctcagggtgttcagctgacatagattccggcaaacagtcattgccctacccacagccaggtttggagtcagctggcatagaaagcccaacttccagtgtcctggacaagaaggagggtgaacaggccaaagccatctttgaaaaagtgaaaagattccgcatgcatgtggagcagaaggacatcatttatagagtatatctgaaacagataatagtcaaagtcattttgtttgtgctcatcataacttatgttccatattttttaacccacatcactcttgaaatcgactgttcagttgatgtgcaggcttttacaggatataagcgctaccagtgtgtctattccttggcagaaatctttaaggtcctggcttcattttatgtcattttggttatactttatggtctgacctcttcctacagcctgtggtggatgctgaggagttccctgaagcaatattcctttgaggcgttaagagaaaaaagcaactacagtgacatccctgatgtcaagaatgactttgccttcatccttcatctggctgatcagtatgatcctctttattccaaacgcttctccatattcctatcagaggtcagtgagaacaaactgaaacagatcaacctcaataatgaatggacagttgagaaactgaaaagtaagcttgtgaaaaatgcccaggacaagatagaactgcatctttttatgctcaacggtcttccagacaatgtctttgagttaactgaaatggaagtgctaagcctggagcttatcccagaggtgaagctgccctctgcagtctcacagctggtcaacctcaaggagcttcgtgtgtaccattcatctctggtcgtagaccatcctgcactggcctttctagaggagaatttaaaaatcctccgcctgaaatttactgaaatgggaaaaatcccacgctgggtatttcacctcaagaatctcaaggaactttatctttcgggctgtgttctccctgaacagttgagtactatgcagttggagggctttcaggacttaaaaaatctaaggaccctgtacttgaagagcagcctctcccggatcccacaagttgttacagacctcctgccttcattgcagaaactgtcccttgataatgagggaagcaaactggttgtgttgaacaacttgaaaaagatggtcaatctgaaaagcctagaactgatcagctgtgacctggaacgcatcccacattccattttcagcctgaataatttgcatgagttagacctaagggaaaataaccttaaaactgtggaagagatcattagctttcagcatcttcagaatctttcctgcttaaagttgtggcacaataacattgcttatattcctgcacagattggggcattatctaacctagagcagctctctttggaccataataatattgagaatctgcccttgcagcttttcctatgcactaaactacattatttggatctaagctataaccacttgaccttcattccagaagaaatccagtatctgagtaatttgcagtactttgctgtgaccaacaacaatattgagatgctaccagatgggctgtttcagtgcaaaaagctgcagtgtttacttttggggaaaaatagcttgatgaatttgtcccctcatgtgggtgagctgtcaaaccttactcatctggagctcattggtaattacctggaaacacttcctcctgaactagaaggatgtcagtccctaaaacggaactgtctgattgttgaggagaacttgctcaatactcttcctctccctgtaacagaacgtttacagacgtgcttagacaaatgttgacttaaagaaaagagacccgtgtttcaaaatcatttttaaaagtatgctcggccgggcgtggtggctcatgcctataatcccagcactttgggaggccaagatgggcggattgcttgaggtcaggagttcgagaccagtctggccaacctggtgaaaccccatctctgctaaaactacaaaaaaattagccaggcgtggtggcgtgcgcctgtaatcccagctacttgggaggctgacgcaggggaattgcttgaaccagggaggtggaggttgcagtgagccgagattgtgccactgtacaccagcctgggtgacagagcaagactcttatctcaaaaaaaaaaaaaaaatgctccagggctttaaatgagaagtaaaattttctaagttaataaagatgaagaatgggtgactattatgatgaaccataactaaatgtcttattaaagcaactgagtgtctagccctaaattaaccaggtaaaaactgttaacactaacctgaagttttgtgaataactgttctttaacttattgagatgttgcaagaaatgcacatccagggtggactgggagctatgaaatgactaaattcctccttgcagtgtttaccttcaagattgtataggtattctctcctcttcttcccccagtccccattacttatttgcacacttgttttaactgacttcctgttttgatatttatcaccaagaccataaactcatcaatatgaattttcttgatgtatactcacgactgtctttgatttatgttcctaaatttttttagatagggtatgttgtgcttggcagaattcttttttggcttaatttttacttcctttcccagcttgcttgagtcttccttaacctggttttctcttaacaccaatgatgaaccctgagaaaatgcctgcatttggcctttgcctagaacaggagctgagtatttaagatgtattatcctcggggcatcctgaaaattaatgtattccctaaaatttcttcttgtctatcatcaaggcctttttttatttgttaagaatttttatattaaatgtaaaacatataaatattttctattgtataatcttggattcaacatctgtgaggatcatttttgtaagatacatagaatttgtgcatttctttatgaacttactgttagtgttcttggtttcggctgtttatgactcatgtttatgtacattctgctccaaaatgtttttgtactctgcaactaattacttttggataacaaaagccttgtgtttaatgccctaaagtatttgggggtttccttgtgagagggtggccgaatcatctacctctctcttccatagttgctgtgcaatcgtacgggtaaaattcttaattacttacaaaaactgtgatagaggggagaggtacagatttggtttttaaattgattttaaaatactttatagaaatttagtaagagttaaagcaaaagactttttttccctccatctatgtaatctctagctatgattataatgtaaaacagcctctattcagtgtctaaaatgagttctcaaaacccacaaagaaatagatccatttaactgaaattcatctcatgcctttatctaactcttctggaaaatacattttgctcctttttataaagagctttgtgcttggccttttattatgcatatttttaatgaataaaatcaactgactcatttttgggaaatgtacatctttaatatgtttttccctaagggtctaggcattatgatgccacctcttcattttggatataactatgaagaaatctattaactgcacctacacaaaactggaaaacactataggtaaacagtactgtgtatatggaattgtggtgcgtggtatgtgttttctcttgctttgttccagaaagatgaaagtgagtctttaaagcatagcaaatagagcttcccctcacctgccacacactcctgcactaaagttcaaagaaaagaattattcaaatcaaatgaaatttgaataatattagctatcaggaatataggacaccaaacacactgcctcacacattattgtttattctgaacggaaaggaacagtgtaaaaataaactacttaccaaaacttgcctttagtcagaacattcagctctcagggaagcaggtataactgatgaaacttctaggacttcagaaaacagattctaattatatccatgtttttcgttgttattttcattttttaaagtgtgagttgatgtttattttagtgtttcacaatagaattatcatgtatactgattccagtgtggcatgtgattaagttttggacatgaatatgccaaaagtgcttaaatgtttttggccacataactagctagaatttcaaaacaaaattcagatttgctaccattcacctgacgaacttctccatggctcgtcactggtttggttcaactgcagaagtcattggctaaattttccttatcacctacgtaaatttctagaagaatttactagcaggattaataatgaatattataaactgctttccacacactagggtataattattggtgcaatctatgttgttcttgatgccatggttttacatcttttaatttaaaccttatacaccagtgtttaggtcgcttttgagacaaggtagccctgatgcaaggaaaaatgaggctactacttcacataaaaaatagggtgttaataccacctttactgtactgttggagcagatctttattttacaagtgttcatattcacataagagaattttaaatgaagaaaattaagtttgttaaattataattatgagactttcgttggcatttgatttcaagaatacatatgcattttccaaaaaataaatgtggaggttattcagaacaaaattcatagcttacggtagtaatggcatggattaattttatttgcatgcacacacagacacacatacttcatatatgcaaattatagcattagtttttgatatatctagtggtttttttttcaaaattgcaggaggttgtagattaaattaagtatgatagcacgttttttaattcattaatcatgaagtgctctgttccctaagttatgacatttagaagaaatcacatgctcaaccttaatctgagaacctaagtgtttttgagcattccagtaaaggagtagtgttcttttcctaacttacatcagggtacatctgtgtggcacacagatactatcttttcattcttcactcccagtcttaatttctttcccctgtatgtcactgtattttatgtcacttcacattgtgttaaacagggtaaatagagatcctcagtatctcagtgctgtggcatagctccaataggtgtgctgtggtgcactgcagtgatgtatttgcataacattgtttgatagtgaaaaattttttttcggttcaagtgttttgtgattaaaattttatgtttaattaaaatattgcataatattgatgggttcaaaaaccattaaaataatcaaacaattattctgtgcccttaacattattttcttgtgttttcaataaaattttcttttcatctttccatcttcacattctcttagcatcatcctatgcacataaggtatgttgttttccttctccactcacctaccgcactaaatttgatcagcaattgtacagtaacagaatatatttgtgccagaagatttgcaatgatatttgagcatgtatttatttaggaggaagccagtgcctgtaattatgtctcattgagtagttttactttgcccatcctgcagtatttagagctgatctgtacccaaagcaggacaatgtaactgtagatctgctttgttttcagtaactgtacattgcatcagaatctgtttatttctatctggaaacagacagaatggtgggggagggaaggagttattttgcatcctagtttgtattatgaagtcatcatatatatatttgaaatagtataagctaattactgttgcagaatgccctcgatataattatttcttttcagctggatgtgaaaagctgaagcagtgaaaacctgcagtcttatttcactggtttccttctgtttcttgtccatcacttctgtatccacagggagctatctactacatacctttggtaacaggctacattctcttcagattttttatatgaataatttcatcagcactaaagcattaacatagaataatgagccaaagtactgagtcgagatggctttcagttgagtttaatttcatatttaacttttgcatttaacttgtataatacactactgctgagaaaaacaattatgaatgccttctgcatgttgtacattatctctaacagagatggtgcaattttaagaatacaaaggggtatagagttagaatggatgtgttcgtgcatatatatgttgtatttaaatattaatgtttacaagaagattttttttaaattcttcaaatacttcacttagtgaaataatgggccaatctggaatagagacattttatttggttagtgcaagagtgaaagctagcatttgttaaccttcacatatttatctgtgtacaattgtttttgcttctggtaatgaattattagaaaatggaagattttgttcaatgtttttggccctcaggtttactgtgtaaatctgcatttttggtggtaaatccctttgccacagattcagtagcttttggtaaacttcactgtttttaaagtaccttttgtgtaaaataaagatccaatttttataacaaatggcaaataaaaacagtaaatgctggaagaa

SEQ ID NO: 148204 - DNA, 1957 bp, Homo sapiens
  Payload ID: 9340
  Gene Symbol: LRRC8B
  Gene Name: leucine rich repeat containing 8 family, member B
  ENST ID: ENST00000358200
  CDS Start-End: 148-840
tccagttgaccagcattcataggaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgcccagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaatgacctccaccgacagcagtactcctatattgatgccgtctgttacgagaaacagctccattggtttgcaaagtttttcccctatctggtgctcttgcacacgctcatctttgcagcctgcagcaacttttggcttcactaccccagtaccagttccaggctcgagcattttgtggccatccttcacaagtgcttcgattctccatggaccacccgcgccctttcagaaacagtggctgagcagtcagtgaggcctctgaaactctccaagtccaagattttgctttcgtcctcagggtgttcagctgacatagattccggcaaacagtcattgccctacccacagccaggtttggagtcagctggcatagaaagcccaacttccagtgtcctgacagaaggagggtgaacaggccaaagccatctttgaaaaagtgaaaagattccgcatgcatgtggagcagaaggacatcatttatagagtatatctgaaacagataatagtcaaagtcattttgtttgtgctcatcataacttatgttccatattttttaacccacatcactcttgaaatcgactgttcagttgatgtgcaggcttttacaggatataagcgctaccagtgtgtctattccttggcagaaatctttaaggtcctggcttcattttatgtcattttggttatactttatggtctgacctcttcctacagcctgtggtggatgctgaggagttccctgaagcaatattcctttgaggcgttaagagaaaaaagcaactacagtgacatccctgatgtcaagaatgactttgccttcatccttcatctggctgatcagtatgatcctctttattccaaacgcttctccatattcctatcagaggtcagtgagaacaaactgaaacagatcaacctcaataatgaatggacagttgagaaactgaaaagtaagcttgtgaaaaatgcccaggacaagatagaactgcatctttttatgctcaacggtcttccagacaatgtctttgagttaactgaaatggaagtgctaagcctggagcttatcccagaggtgaagctgccctctgcagtctcacagctggtcaacctcaaggagcttcgtgtgtaccattcatctctggtcgtagaccatcctgcactggcctttctagaggagaatttaaaaatcctccgcctgaaatttactgaaatgggaaaaatcccacgctgggtatttcacctcaagaatctcaaggaactttatctttcgggctgtgttctccctgaacagttgagtactatgcagttggagggctttcaggacttaaaaaatctaaggaccctgtacttgaagagcagcctctcccggatcccacaagttgttacagacctcctgccttcattgcagaaactgtcccttgataatgagggaagcaaactggttgtgttgaacaacttgaaaaagatggtcaatctgaaaagcctagaactgatcagctgtgacctggaacgcatcccacattccatt

SEQ ID NO: 148205 - DNA, 763 bp, Homo sapiens
  Payload ID: 9340
  Gene Symbol: LRRC8B
  Gene Name: leucine rich repeat containing 8 family, member B
  ENST ID: ENST00000449440
  CDS Start-End: 453-763
agcggaacgcgtcgcgtcacaatggagccggtcggaggcggcgagccggacagcgccggggcttcccgctgagcccgcagcctccggcagccgggaaagtgcgggcgcggggccgcagcctgcccgcccggagcggcccaggagcacgccgcggggagcgcgggcgtccggggctggagtcgcgcagaatcctcagagtgaaaacaccaacagtaatagttaacctcttctgtgagaagtcagaaggtgatctctttaatgctttctttttaagaatttttcaaattgagactaattgcagaggttccagttgaccagcattcataggaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgcccagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaatgacctccaccgacagcagtactccta

SEQ ID NO: 148206 - DNA, 7474 bp, Homo sapiens
  Payload ID: 9340
  Gene Symbol: LRRC8B
  Gene Name: leucine rich repeat containing 8 family, member B
  Uniprot ID: Q6P9F7
  ENST ID: ENST00000439853
  CDS Start-End: 247-2658
ccctaggtaatagttaacctcttctgtgagaagtcagaaggtgatctctttaatgctttctttttaagaatttttcaaattgagactaattgcagaggttccagttgaccagcattcataggaatgaagacaaacacagagatggtgtgtctaagaaacttcaaaaggtgtagacctcctgactgaagcatattggatttatttaatttttttcactgtatttctgtcctcctacaagggaaagtcatgattacactaactgagctaaaatgcttagcagatgcccagtcatcttatcacatcttaaaaccatggtgggacgtcttctggtattacatcacactgatcatgctgctggtggccgtgctggccggagctctccagctgacgcagagcagggttctgtgctgtcttccatgcaaagtggaatttgacaatcactgtgccgtgccttgggacatcctgaaagccagcatgaacacatcctctaatcctgggacaccgcttccgctccccctccgaattcagaatgacctccaccgacagcagtactcctatattgatgccgtctgttacgagaaacagctccattggtttgcaaagtttttcccctatctggtgctcttgcacacgctcatctttgcagcctgcagcaacttttggcttcactaccccagtaccagttccaggctcgagcattttgtggccatccttcacaagtgcttcgattctccatggaccacccgcgccctttcagaaacagtggctgagcagtcagtgaggcctctgaaactctccaagtccaagattttgctttcgtcctcagggtgttcagctgacatagattccggcaaacagtcattgccctacccacagccaggtttggagtcagctggcatagaaagcccaacttccagtgtcctggacaagaaggagggtgaacaggccaaagccatctttgaaaaagtgaaaagattccgcatgcatgtggagcagaaggacatcatttatagagtatatctgaaacagataatagtcaaagtcattttgtttgtgctcatcataacttatgttccatattttttaacccacatcactcttgaaatcgactgttcagttgatgtgcaggcttttacaggatataagcgctaccagtgtgtctattccttggcagaaatctttaaggtcctggcttcattttatgtcattttggttatactttatggtctgacctcttcctacagcctgtggtggatgctgaggagttccctgaagcaatattcctttgaggcgttaagagaaaaaagcaactacagtgacatccctgatgtcaagaatgactttgccttcatccttcatctggctgatcagtatgatcctctttattccaaacgcttctccatattcctatcagaggtcagtgagaacaaactgaaacagatcaacctcaataatgaatggacagttgagaaactgaaaagtaagcttgtgaaaaatgcccaggacaagatagaactgcatctttttatgctcaacggtcttccagacaatgtctttgagttaactgaaatggaagtgctaagcctggagcttatcccagaggtgaagctgccctctgcagtctcacagctggtcaacctcaaggagcttcgtgtgtaccattcatctctggtcgtagaccatcctgcactggcctttctagaggagaatttaaaaatcctccgcctgaaatttactgaaatgggaaaaatcccacgctgggtatttcacctcaagaatctcaaggaactttatctttcgggctgtgttctccctgaacagttgagtactatgcagttggagggctttcaggacttaaaaaatctaaggaccctgtacttgaagagcagcctctcccggatcccacaagttgttacagacctcctgccttcattgcagaaactgtcccttgataatgagggaagcaaactggttgtgttgaacaacttgaaaaagatggtcaatctgaaaagcctagaactgatcagctgtgacctggaacgcatcccacattccattttcagcctgaataatttgcatgagttagacctaagggaaaataaccttaaaactgtggaagagatcattagctttcagcatcttcagaatctttcctgcttaaagttgtggcacaataacattgcttatattcctgcacagattggggcattatctaacctagagcagctctctttggaccataataatattgagaatctgcccttgcagcttttcctatgcactaaactacattatttggatctaagctataaccacttgaccttcattccagaagaaatccagtatctgagtaatttgcagtactttgctgtgaccaacaacaatattgagatgctaccagatgggctgtttcagtgcaaaaagctgcagtgtttacttttggggaaaaatagcttgatgaatttgtcccctcatgtgggtgagctgtcaaaccttactcatctggagctcattggtaattacctggaaacacttcctcctgaactagaaggatgtcagtccctaaaacggaactgtctgattgttgaggagaacttgctcaatactcttcctctccctgtaacagaacgtttacagacgtgcttagacaaatgttgacttaaagaaaagagacccgtgtttcaaaatcatttttaaaagtatgctcggccgggcgtggtggctcatgcctataatcccagcactttgggaggccaagatgggcggattgcttgaggtcaggagttcgagaccagtctggccaacctggtgaaaccccatctctgctaaaactacaaaaaaattagccaggcgtggtggcgtgcgcctgtaatcccagctacttgggaggctgacgcaggggaattgcttgaaccagggaggtggaggttgcagtgagccgagattgtgccactgtacaccagcctgggtgacagagcaagactcttatctcaaaaaaaaaaaaaaaatgctccagggctttaaatgagaagtaaaattttctaagttaataaagatgaagaatgggtgactattatgatgaaccataactaaatgtcttattaaagcaactgagtgtctagccctaaattaaccaggtaaaaactgttaacactaacctgaagttttgtgaataactgttctttaacttattgagatgttgcaagaaatgcacatccagggtggactgggagctatgaaatgactaaattcctccttgcagtgtttaccttcaagattgtataggtattctctcctcttcttcccccagtccccattacttatttgcacacttgttttaactgacttcctgttttgatatttatcaccaagaccataaactcatcaatatgaattttcttgatgtatactcacgactgtctttgatttatgttcctaaatttttttagatagggtatgttgtgcttggcagaattcttttttggcttaatttttacttcctttcccagcttgcttgagtcttccttaacctggttttctcttaacaccaatgatgaaccctgagaaaatgcctgcatttggcctttgcctagaacaggagctgagtatttaagatgtattatcctcggggcatcctgaaaattaatgtattccctaaaatttcttcttgtctatcatcaaggcctttttttatttgttaagaatttttatattaaatgtaaaacatataaatattttctattgtataatcttggattcaacatctgtgaggatcatttttgtaagatacatagaatttgtgcatttctttatgaacttactgttagtgttcttggtttcggctgtttatgactcatgtttatgtacattctgctccaaaatgtttttgtactctgcaactaattacttttggataacaaaagccttgtgtttaatgccctaaagtatttgggggtttccttgtgagagggtggccgaatcatctacctctctcttccatagttgctgtgcaatcgtacgggtaaaattcttaattacttacaaaaactgtgatagaggggagaggtacagatttggtttttaaattgattttaaaatactttatagaaatttagtaagagttaaagcaaaagactttttttccctccatctatgtaatctctagctatgattataatgtaaaacagcctctattcagtgtctaaaatgagttctcaaaacccacaaagaaatagatccatttaactgaaattcatctcatgcctttatctaactcttctggaaaatacattttgctcctttttataaagagctttgtgcttggccttttattatgcatatttttaatgaataaaatcaactgactcatttttgggaaatgtacatctttaatatgtttttccctaagggtctaggcattatgatgccacctcttcattttggatataactatgaagaaatctattaactgcacctacacaaaactggaaaacactataggtaaacagtactgtgtatatggaattgtggtgcgtggtatgtgttttctcttgctttgttccagaaagatgaaagtgagtctttaaagcatagcaaatagagcttcccctcacctgccacacactcctgcactaaagttcaaagaaaagaattattcaaatcaaatgaaatttgaataatattagctatcaggaatataggacaccaaacacactgcctcacacattattgtttattctgaacggaaaggaacagtgtaaaaataaactacttaccaaaacttgcctttagtcagaacattcagctctcagggaagcaggtataactgatgaaacttctaggacttcagaaaacagattctaattatatccatgtttttcgttgttattttcattttttaaagtgtgagttgatgtttattttagtgtttcacaatagaattatcatgtatactgattccagtgtggcatgtgattaagttttggacatgaatatgccaaaagtgcttaaatgtttttggccacataactagctagaatttcaaaacaaaattcagatttgctaccattcacctgacgaacttctccatggctcgtcactggtttggttcaactgcagaagtcattggctaaattttccttatcacctacgtaaatttctagaagaatttactagcaggattaataatgaatattataaactgctttccacacactagggtataattattggtgcaatctatgttgttcttgatgccatggttttacatcttttaatttaaaccttatacaccagtgtttaggtcgcttttgagacaaggtagccctgatgcaaggaaaaatgaggctactacttcacataaaaaatagggtgttaataccacctttactgtactgttggagcagatctttattttacaagtgttcatattcacataagagaattttaaatgaagaaaattaagtttgttaaattataattatgagactttcgttggcatttgatttcaagaatacatatgcattttccaaaaaataaatgtggaggttattcagaacaaaattcatagcttacggtagtaatggcatggattaattttatttgcatgcacacacagacacacatacttcatatatgcaaattatagcattagtttttgatatatctagtggtttttttttcaaaattgcaggaggttgtagattaaattaagtatgatagcacgttttttaattcattaatcatgaagtgctctgttccctaagttatgacatttagaagaaatcacatgctcaaccttaatctgagaacctaagtgtttttgagcattccagtaaaggagtagtgttcttttcctaacttacatcagggtacatctgtgtggcacacagatactatcttttcattcttcactcccagtcttaatttctttcccctgtatgtcactgtattttatgtcacttcacattgtgttaaacagggtaaatagagatcctcagtatctcagtgctgtggcatagctccaataggtgtgctgtggtgcactgcagtgatgtatttgcataacattgtttgatagtgaaaaattttttttcggttcaagtgttttgtgattaaaattttatgtttaattaaaatattgcataatattgatgggttcaaaaaccattaaaataatcaaacaattattctgtgcccttaacattattttcttgtgttttcaataaaattttcttttcatctttccatcttcacattctcttagcatcatcctatgcacataaggtatgttgttttccttctccactcacctaccgcactaaatttgatcagcaattgtacagtaacagaatatatttgtgccagaagatttgcaatgatatttgagcatgtatttatttaggaggaagccagtgcctgtaattatgtctcattgagtagttttactttgcccatcctgcagtatttagagctgatctgtacccaaagcaggacaatgtaactgtagatctgctttgttttcagtaactgtacattgcatcagaatctgtttatttctatctggaaacagacagaatggtgggggagggaaggagttattttgcatcctagtttgtattatgaagtcatcatatatatatttgaaatagtataagctaattactgttgcagaatgccctcgatataattatttcttttcagctggatgtgaaaagctgaagcagtgaaaacctgcagtcttatttcactggtttccttctgtttcttgtccatcacttctgtatccacagggagctatctactacatacctttggtaacaggctacattctcttcagattttttatatgaataatttcatcagcactaaagcattaacatagaataatgagccaaagtactgagtcgagatggctttcagttgagtttaatttcatatttaacttttgcatttaacttgtataatacactactgctgagaaaaacaattatgaatgccttctgcatgttgtacattatctctaacagagatggtgcaattttaagaatacaaaggggtatagagttagaatggatgtgttcgtgcatatatatgttgtatttaaatattaatgtttacaagaagattttttttaaattcttcaaatacttcacttagtgaaataatgggccaatctggaatagagacattttatttggttagtgcaagagtgaaagctagcatttgttaaccttcacatatttatctgtgtacaattgtttttgcttctggtaatgaattattagaaaatggaagattttgttcaatgtttttggccctcaggtttactgtgtaaatctgcatttttggtggtaaatccctttgccacagattcagtagcttttggtaaacttcactgtttttaaagtaccttttgtgtaaaataaagatccaatttttataacaaatggcaaataaaaacagtaaatgctgg

SEQ ID NO: 148207 - DNA, 7218 bp, Homo sapiens
  Payload ID: 9341
  Gene Symbol: LRRC8C
  Gene Name: leucine rich repeat containing 8 family, member C
  Uniprot ID: Q8TDW0
  ENST ID: ENST00000370454
  CDS Start-End: 256-2667
gtccgcggccggggaggcggaggggaggagggcttgcggggctggggcgttagctgcgtcccggctggaagcccgcgaagagaagtaggaggaaggcgccgccgtggccgcggccgcagtgctcgggcgcgacaagccatgagcagcgaccccgcgggcgacgccgccgtccctggcagccgctgagcccgacccccaggcagctcgccgctccctagcaccttctccagtcgacactctcgcgcccggagaaacatgattcccgtgacagaattccggcagttctctgagcagcagcctgccttccgagtgctgaagccatggtgggatgtgtttaccgattacctctcagtagccatgctcatgatcggcgtgtttggatgtactttacaggtcatgcaagacaagataatctgccttccgaaaagagtgcagcctgctcagaaccactcttccctttcgaatgtctctcaagcagttgccagtaccactccactgcctccacctaaaccatctcctgctaaccccatcactgtggaaatgaaaggcctgaagacagatttggaccttcagcagtacagctttataaatcagatgtgttatgagcgagccctccactggtatgccaagtatttcccttaccttgtcctcatccataccctggtctttatgctctgcagtaacttttggttcaaattccctggttccagctccaaaatagaacatttcatctccattctggggaagtgttttgactctccttggaccacacgggctttatctgaagtgtctggggaggactcagaagaaaaggacaacaggaagaacaacatgaacaggtccaacaccatccaatctggtccagaagacagcctggtcaactctcagtctttaaagtccattcctgagaagtttgtagttgataaatccactgcaggggctctggataaaaaggaaggtgagcaggctaaggccttatttgagaaggtgaagaagttcaggctgcatgtggaagaaggtgatattctatatgccatgtatgttcgccagactgtacttaaagttatcaaattcctaatcatcattgcatataatagtgctctggtttccaaggtccagtttacagtggactgtaatgtggacattcaggacatgactggatataaaaacttttcttgcaatcataccatggcacacttgttctcaaaactgtccttttgctatctgtgctttgttagtatctatggattgacgtgcctttataccttatactggctgttctaccgttctctacgggaatattcctttgagtatgtccgtcaggagactggaattgatgatattccagatgtgaaaaatgactttgcttttatgcttcatatgatagatcagtatgaccctctctattccaagagatttgcagtgttcctgtctgaagtcagtgaaaacaaattaaagcagctgaacttaaataacgaatggactcctgataaactgaggcagaagctacagacaaatgcccataatcgactggaattgcctcttatcatgctctctggccttccagacactgtttttgaaatcacagagttgcaatctctaaaacttgaaatcattaagaacgtaatgataccagccaccattgcacagctagacaatcttcaagagctctctctgcaccagtgttctgtcaaaatccacagtgcggcgctctctttcctgaaggaaaacctcaaggtcttgagcgtcaagtttgatgacatgagggaactccccccctggatgtatgggctccgaaatctggaagagctgtacctagttggctctctaagtcatgatatttccagaaatgtcacccttgagtctctgcgggatctcaaaagccttaaaattctctctatcaaaagcaacgtttccaaaatccctcaggcagtggttgatgtttccagccatctccagaagatgtgcatacataatgatggcaccaagctggtgatgctcaacaacttaaagaagatgaccaatctgacagagctggagctggtccactgtgacctggagcgtattcctcatgctgtgttcagcctactcagcctccaggaattggacctgaaggaaaacaatctgaaatctatagaagaaatcgttagctttcagcacttaagaaagttgacagtgctaaaactgtggcataacagcatcacctacatcccagagcatataaagaaactcaccagcctggaacgcctgtcctttagtcacaataaaatagaggtgctgccttcccacctcttcctatgcaacaagatccgatacttggacttatcgtacaatgacattcgatttatcccccctgaaattggagttctacaaagtttacagtatttttccatcacatgtaacaaagtggaaagccttccagatgaactctacttctgcaagaaacttaaaactctgaagattggaaaaaacagcctatctgtactttcaccgaaaattggaaatttgctatttctttcctacttagatgtaaaaggtaatcactttgaaatcctccctcctgaactgggtgactgtcgggctctgaagcgagctggtttagttgtagaagatgctctgtttgaaactctgccttctgacgtccgggagcaaatgaaaacagaataacttatttttcgttaaagtttgactgaaacacgcttctaccaaatacagtataaataattaggtagtcttaatgcctttcctatttttttttccttttcacacaaaatgtacacaaagatcgcgtaaggagtatgtatttttaataaaaatttaattgtattttttcaatattaatattttgaagttttatttgtcttgaaacacaatgtatctattatctactgacagaaagagatagttccatttggttttttgtttttgttttttagttcattcttgtggaaaggagggaattataagttgcatgctttttggcattttttaaatagaggaagatattttgccaaggccatttttaacttgtttacacctgtacagggttcttatttttgttttcattgtgtgtgtatcaaggaatctgtgctagttattttaataccagctgtcttctccattggccaagaccttcattcagtggaacttcacataagtgcattgtcatagagtattttaaatgttcccctgcctccaacaaaaccctaaactgtgttatttcatatacctgacagttattgttatccttaggcaaggtttttgtgagtgaagaaaataatctttagtggctggtatgtttgaattaggcctttatcatttaacttatttgcattttaccaacattttaaaaatatttaaaacctaaatacagaggctcctcccaccttaatctcaatactgctatgtagtactggtgaacaactttggagaacctagatttattttaatattctaatagataattaaattttaaaatgatagaagcctggtttttgagtaatttaatcatctttcatatcttgatatgcagctgcatcagatggaaaaaaatttactaaagcaccctgttaaagagctggtgtgctccagtgaggccctctccttttctcagcacagtgtggcagtggtaatctattcaaattttgcctgttacacaaaataatccacttatatatacagtcagccttccgtacttgtgggttctgcatctgtggattccaccaactgtagatggaaaatactcaaaaagaaagttgtgtctgtactgaatatgtacagactttttccttgtcattattccctaaacaatacagcgtaacaactatttaaataggatttacattgttttaggtattataaattacctagagatgatttaaagtatatgggaggatgtgcataggttatatgcaatttctgcaccattttatgtcaaggattttgaacatcctcagattttggtgttcgagggcatcctggaatcaattccccatgataccgagggatgactggatattaatcgatttccctcaagcctgcccttgctgtgaactagtgctacaagcacgggaaatccatctgctctctggcttaaaatatgtatctcatctaaaattgttcgttaaagtgtgaataaattgctaagtggttgttgcttagcaataatttttgcctgaccatcagcagagcttttatttacctttgtaattaaaatccaacatagcatgggctcttgggcaaaatatttcactgactattaagcatgtagaacaggaaaatgaaatacactatttgtgcccttgacctagaaccagaaccactaattatgagaactttgttttatgtaccaaattcacattgaccattttctgagctctagactgatcgtagtaagttttgtgacttaacaatgaaagaaagtagaaagatgctttgggttttcaaaatgttgttttttaaaattgttctttgggtgaatttactcagtgctgctttgagttgtatacagaaacaaatgttgggaattgctcctcagaaatgtgttcctaagttgtgttttcaactttacatcatgaggtgaagcattagggaaagagattctttcgatttgtttaataatctaattatacagaccaaagtgctttacgtttctgctctatgttaatgttttagaatggtgattttgctgattaatttagacctggaattgaaataatgtgctcagaataataacatggttatagttcttgtatgataaagtattcaatttcagaatagtgttggaatcctgagtttgaataatgtgttgtatttagaaacatagccctatctgttttaaacaaataatttgttggccgattgtccatggttgagcatgacaaaaatacctcgtcgaaaggcaagcttaggtaactgctggcaaaacactgggtgcactatttttctggataaaatttatagttattttctatattacccttcaaaagggatctcttcaggttaaaaatcacgcttatgctgaagtctttatctggtgttaactaaaaatctcatatgggttcataaccgaggtcactaataattcatttttatcacttgtaaaaatttgctcaaaattccaaaaaaatattgatttgttttttagtgattttgcaggctgacccccaacctaagttttgataacatctggtaagtcagtatagttctgtgacttcatgttttaactaagaaggaaaattcatagatattcctattagattttataaaccttcaaaagtctgaaacttaattttgagtctaaattttctgacactggccccttttaatattgtaagtttttgttcactttcttaagtaaaaaaaacatttaattactagttagcccttaactgggaaactcaggtaatgaactgctgacttttctaaagttctttaactgatcaattctgtatagagggatatttatctaaccactttccgtattttacaagtgctctttctaaaaaggaataactattatagctctatttccccaatctctataggactcatgagagattgcttgtgtaaatataaaagcaccatatgtgttcttaactcctatggctgcttgaagctcatgatgaaaaagtctttttgtcagttttaattgttaagtacagaacaaacaattgtttggtgatggcctggttgaaagagagcatataaatatatcccagtggaactcaccaaagaagaccacacctcagaaattattgcattttctcattatgtgttgggtttgatttgcttttgtttttaatgcagctcttttaatataaagattcttgatacagtgaaatctcttatttcaagtgtaagttattcttcacccaccccttcccctgccattgtatttcccatctgtttcaaggagtttcaacaatttacattgcatcgtatgcagtaggtactgctttttcagaaagacctggaaaacatacctgctatgaatattttgttcagatgtagccatttacctggctctcaagttgtctttgtggagagggtcttagacaaaaatcttccttgtatttacttgggttaagtgaagtccaaattcttacagtatgctatttcaggatttctgatattaaaaaagaaaaaacaaaatctttatatctcttattaacacttcccccaagaagggttgtgctgttatttattttctattataagaaaagttcattctttaagtagtttcttttacctctaatctaatttcataccaaatacctgatcaatagaaatgatatatttaagcagcaaagattcctaatccatcattatgaaaagtgtcagcatacttagtagtgaacagataaagtcaatttgaatataattccactttgtttttagagactaaattaagattcaattaacattatcctatgaattctgaatgtgataatgtgattcaaacagtcaaattttattaagctcttagtaactcaggatagcattccatactaacctcaagttagcaaaacaaattagttaaacagcttggttcttagcagactgcttaaaagatcaagaaaattttctcatcttttctttctacttagaaacattgcaagaaaccttggacagtcttcaccagacctgccatgattttataagatttaggcctcagtgacatgctcctgaaagtttcctgccagccatccaaactaagcatccactcattccatcttcccaaagtcactcaccgataaaggtagcatccttaagttcatttttgaaaggtggaggaggatctccccctgcccaaaggaatttttttatcagaataccttgaaaggggggtatataaatttggaaaacttaatttcttggctgtgtttgataacagttcctatgcatggtttttaatgtgaggtaaatttgtttctttcttcagaatacctctctccaccccccaccttattcttcctctttaatgaatatttttattggagctcaaactccatgacttacgtgctcactaagttttcttttttccccttgtttactctgtctgtatgtatgtcaaaagctggcaaaacctctaaaactgtcaagaaaatgcttgaaagttgatttgtcatagtgcaaattcatgataaaatgtcttaatgttatttggatatgtagtacatagaaacagaaaaataaagtcatttttataacttaaaa

SEQ ID NO: 148208 - DNA, 504 bp, Homo sapiens
  Payload ID: 9341
  Gene Symbol: LRRC8C
  Gene Name: leucine rich repeat containing 8 family, member C
  ENST ID: ENST00000482063
  CDS Start-End: 147-323
gcggccgcagtgctcgggcgcgacaagccatgagcagcgaccccgcgggcgacgccgccgtccctggcagccgctgagcccgacccccaggcagctcgccgctccctagcaccttctccagtcgacactctcgcgcccggagaaacatgattcccgtgacagaattccggcagttctctgagcagcagcctgccttccgagtgctgaagccatggtgggatgtgtttaccgattacctctcagtagccatgctcatgatcggcgtgtttggatgtactttacaggcagtttctctgaagctaagtggttttattttgttttaacctcagccctttggtgtctcattcatgcaaatgtggtaccttttcaactagttatcacaggctgctgttacaaagatatggcaaaaacactgtttaaccttttgaagaagaagaagaagatgacgaagaagaagacaaagaagaagaagctgcctgccttattttttttcttatttttctc

SEQ ID NO: 148209 - DNA, 3950 bp, Homo sapiens
  Payload ID: 9342
  Gene Symbol: LRRC8D
  Gene Name: leucine rich repeat containing 8 family, member D
  Uniprot ID: Q7L1W4
  ENST ID: ENST00000337338
  CDS Start-End: 408-2984
aattcccctcgttacagagtcatgtgctgctgctcccgtcgccgctgctgccgctgccgctgccgccgcccgtggtgccccggctcctccgccgcgcttcgaggtggcagccgcgggcggggccgcgggagcagggtccagggtgcagcgcgccttcgccgccccggcgcgtcccggtgcagccgccgcccgccgcgggtgatgccgccacctccggcctcagcataagccgtggcttggcggccgagctgcaccccaaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactatatcaccttttttgaggggtcttaatttactttgcttaattggtgcaatattgctttaactccgttcactaaagacaaacacatcaagtccaaacttgtaaatttagatttgctgaaatactgatttatttcctgttttaatttaaagtgcctcaagtaagcacctctcacaacagttgactggtactgctgctcctgagcacctcgtgtcatagattttatactcttacagacttggaatgcagtagaggtatgtggatttttaggggttttgtttttttaagaataagtaacaagaaataacacatttcttaataatagcttttttgacatagtttggagttctgattatatggtacatttttctaccagtaatatagggttgccaataaatagaaaatgttttctaaaaataaattttattacaacaaaataaaaattttaatgacttattaacacaacctccagtatcaccaccatttggaagataacacagaatcacaagtatcatttaatttcttgcccttttcagtgttgttctggtgttggtgggaaaataataggaaatgtagttcattgggtagggaaactcttacctttccctatcttaat

SEQ ID NO: 148210 - DNA, 3345 bp, Homo sapiens
  Payload ID: 9342
  Gene Symbol: LRRC8D
  Gene Name: leucine rich repeat containing 8 family, member D
  Uniprot ID: Q7L1W4
  ENST ID: ENST00000394593
  CDS Start-End: 413-2989
ataatccgcttctagcttgtttggaggcgtgggctcttgggagcgggacttctgctcaaatcctgtccaggggcttgaaaaggaggagaattgggggtggttgccgggaggaccagcacctccagttactggagggttgataggggccttctcctttccgtcaccctttactagggggtatcccttgcagataaatgagattttttgatttcttaaaaagccagctgcagtgaagaagaactgctgcaggtcgaggggaagagaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactata

SEQ ID NO: 148211 - DNA, 905 bp, Homo sapiens
  Payload ID: 9342
  Gene Symbol: LRRC8D
  Gene Name: leucine rich repeat containing 8 family, member D
  ENST ID: ENST00000441269
  CDS Start-End: 82-905
aaaagaaagctggattgccttaccaaatctccaggtttttcgttatacctcttcactcaggctctgcccagaactcaaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaat

SEQ ID NO: 148212 - DNA, 666 bp, Homo sapiens
  Payload ID: 9342
  Gene Symbol: LRRC8D
  Gene Name: leucine rich repeat containing 8 family, member D
  ENST ID: ENST00000414841
  CDS Start-End: 317-666
tcttttgagccagcgaggcacaagacaagtaatttcccatcttgaatctctcacagctgctgagctgtagtggatatactgggatgtggctatgaactttaaaaatttgcataaatccagcccctactcccctgcaaaggctcagtcttgtctttacaccttccccgaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcg

SEQ ID NO: 148213 - DNA, 922 bp, Homo sapiens
  Payload ID: 9342
  Gene Symbol: LRRC8D
  Gene Name: leucine rich repeat containing 8 family, member D
  ENST ID: ENST00000527156
  CDS Start-End: 363-922
agggggggcccgggccgaggccgcgccacctcggcaccacgcgggcagccggtgcggcggggtcgccacggccaggggagcgctgggtgcccaccatggcagttatgcaagcggtgaccccctggtcttgcctccccgccgccctgcactccttcctccccgctgccgacacttggatctctctagctctttctctcccctgtgttttcaaacaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcc

SEQ ID NO: 148214 - DNA, 597 bp, Homo sapiens
  Payload ID: 9342
  Gene Symbol: LRRC8D
  Gene Name: leucine rich repeat containing 8 family, member D
  ENST ID: ENST00000532201
  CDS Start-End: 233-597
acaatagccatgtgtgtcaggcagtgagctgaccagcaagtcctttgtgagtcttggaatgcattttccatgggtgggtggtgaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcgcacagatttcgcact

SEQ ID NO: 148215 - DNA, 588 bp, Homo sapiens
  Payload ID: 9342
  Gene Symbol: LRRC8D
  Gene Name: leucine rich repeat containing 8 family, member D
  ENST ID: ENST00000525774
  CDS Start-End: 497-588
ccatgttacgctttgtctaattcccctcgttacagagtcatgtgctgctgctcccgtcgccgctgctgccgctgccgctgccgccgcccgtggtgccccggctcctccgccgcgcttcgaggtggcagccgcgggcggggccgcgggagcagggtccagggtgcagcgcgccttcgccgccccggcgcgtcccggtgcagccgccgcccgccgcgggtgatgccgccacctccggcctcagcataagccgtggcttggcggccgagctgcaccccaaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggagtccccgggccccaggctgcagactggtacctgtcgagagctgttaggaactgggcttcacggcagtaggaatgtttacccttgcggaagttgcatcacttaatgacattcagccaacttaccgaatcctgaaaccatggtgggatgtgtttatggattacct

SEQ ID NO: 148216 - DNA, 3595 bp, Homo sapiens
  Payload ID: 9343
  Gene Symbol: LRRC8E
  Gene Name: leucine rich repeat containing 8 family, member E
  Uniprot ID: Q6NSJ5
  ENST ID: ENST00000306708
  CDS Start-End: 102-2492
gactcaccctcgcggcccgcccgggaactctgcgggagtcgcggcagctccgctcccagagacccaggagttgggcccagcgtccctcccggaacggcagcatgatcccagtggccgagttcaagcagttcacggaacagcagcctgcgttcaaggtgctcaaaccctggtgggacgtgctggccgagtacctcaccgtggccatgctcatgattggggtctttggctgcaccctccaggtgacacaggacaagatcatctgtctacccaatcatgagctccaggagaacttatcagaggccccgtgccagcaattgctgcctcgggggatccctgagcagattggggccctgcaggaggttaaaggccttaagaacaatttggacctgcagcaatacagctttattaaccagctgtgttatgagacggccctgcactggtatgccaagtacttcccttacctcgtggtcattcacacactcatcttcatggtctgcaccagtttctggttcaagttccctggcaccagctccaagattgaacacttcatctccatcctgggcaagtgtttcgactctccatggaccaccagggccctatccgaggtctccggggagaaccagaagggcccagcagccaccgaacgggctgcggccaccatagtggccatggcagggaccgggccggggaaggcaggggagggtgagaaggagaaagtgctggcggaaccggagaaggtggtgaccgagcctccagttgtcaccctgttggacaagaaggagggtgagcaagccaaagccctgtttgagaaggtgaagaagttccgcatgcacgtggaagagggcgacatcctgtacaccatgtacatccgacagacggtgctgaaagtgtgtaagttcctggccatcctggtctacaacctggtctatgtggagaagatcagtttcctggtggcctgtagggtggagacgtcagaggtcacgggctacgccagcttctgctgcaaccacaccaaggcccacctcttctccaagctggccttctgttacatctcctttgtgtgcatctacggacttacctgcatctacacgctctactggctcttccaccggcccctcaaggagtactccttccgttccgtgcgggaggagactggcatgggggacattcctgacgtcaagaatgacttcgccttcatgctgcacctcatcgatcagtacgactccctctactccaagcgcttcgccgtcttcctgtccgaggtcagcgaaagccgtctaaagcagctcaatctcaaccacgagtggacgcccgagaagcttcgacagaagctgcagcgcaatgccgcgggccggctggagctggccctctgcatgctgccgggtctgcccgacaccgtctttgagctcagtgaggtggagtcactcaggctggaggccatctgcgatatcaccttccccccggggctgtcacagctggtgcacttgcaggagctcagcttgctccactcgcccgccaggctacccttctccttgcaggtcttcctgcgggaccacctgaaggtgatgcgcgtcaaatgcgaggagctccgcgaggtgccgctttgggtgtttgggctgcggggcttggaggagctgcacctggaggggcttttcccccaggagctagctcgggcagccaccctggagagcctccgggagctgaagcagctcaaggtgttgtccctccggagcaacgccgggaaggtgccagccagtgtgaccgacgttgctggccacctgcagaggctcagcctgcacaacgatggggcccgtctggttgccctgaacagcctcaagaagctggcggcattgcgggagctggagctggtggcctgcgggctggagcgcatcccccatgcagtgttcagcctgggtgcgctgcaggaacttgacctcaaggacaaccacctgcgctccatcgaggaaatcctcagcttccagcactgccggaagctggtcacgctcaggctgtggcacaaccagatcgcctacgtccctgagcacgtgcggaagctcaggagcctggagcagctctacctcagctacaacaagctggagaccctgccctcccagctcggcctgtgctcaggcctccgtctgctggatgtgtcccacaatgggctacactccctgccacccgaggtgggcctcctgcagaacctacagcacctggccctctcctacaatgccctggaggccctgcccgaagagctcttcttctgccgcaagctgcggacgttgcttctgggcgacaaccagctgagccagctctcgccccacgtgggtgccctcagagccctcagccgcctggagctcaaaggcaaccgcttagaggcgctgccagaagaacttggcaactgtggggggctcaagaaggcggggctcctggtggaagacacgctttaccagggtctgccggcagaagtgcgggacaagatggaggaggaatgaagctggggtggggccgttttaggtagagccttaaaaatgcttctgccctggaatctcaaccattgtcttccaagataggaagccaagtgggtccaggccaggagatggggggggcgggggcagctgtgtcatctttctggggcccaggaggatctgggctggtttgtctggggagacagacaggatgttgtggagctggggtggaacctggtatggagggattaactcagtcatggcattctccgaccaaaaccacacctgtgtctctggcaggctggctggccttgctcccatccctagaactgctgcctctccctggatattccagctcaattagtgccacatatgggggaaacgacacatcccagtgggatttccaacactccccctccccatgcaacaaagcaacttacttctggagttctctcccaaggagaggacacagacacagttgtttgctgtgttatatgttagctccgaacaatggttctcatttggctaagcatcaaaatcacctagggagtcggtgcaaaacaaaatatcccagtcccctcccctgaaacactgactcaggaggtttggttgggggccaggagtctgttcctaaatattccaggtagttctggtgcaggtaagtggccctgagacagtatgttgggaaatgctgacgtaaaggtatcagggccgggcgctgtggctcatgactataatcccagctgtttgagaggccaatgcaggaggatggttgagctcaggagttcgagatcagcctgggtaacatagcgagaccccacctctgccaaaaaaaaaaaaaatagggtatccaaatatctagattctgatcccttttgaggtcctagaccctttgagaaactgatgaagccaggcacctccttcctcaggaaaatgctggtgtacaaatacacacaaagctcttcaggcagctgatagatttcccccagagagctattcaaggacttcctaaggtgggtggactgcagggttaggacacctgctatagaggtgacatttttccaaggacaagcagggactttggtcttgactgttctctgggtgcttaataaataatactaattatgcaa

SEQ ID NO: 148217 - DNA, 760 bp, Homo sapiens
  Payload ID: 9343
  Gene Symbol: LRRC8E
  Gene Name: leucine rich repeat containing 8 family, member E
  ENST ID: ENST00000598224
  CDS Start-End: 199-760
gctccgctcccagagacccaggagttgggcccagcgtccctcccggaacgaagagacggggtttcaccatgctggccaggctggtttcgaactcctgaccttgtgatccgcctgccttggcctcccaaagtgctgggattacagacgtgagccactgcgcctggcccaacctatgacattttacacttgcatggcagcatgatcccagtggccgagttcaagcagttcacggaacagcagcctgcgttcaaggtgctcaaaccctggtgggacgtgctggccgagtacctcaccgtggccatgctcatgattggggtctttggctgcaccctccaggtgacacaggacaagatcatctgtctacccaatcatgagctccaggagaacttatcagaggccccgtgccagcaattgctgcctcgggggatccctgagcagattggggccctgcaggaggttaaaggccttaagaacaatttggacctgcagcaatacagctttattaaccagctgtgttatgagacggccctgcactggtatgccaagtacttcccttacctcgtggtcattcacacactcatcttcatggtctgcaccagtttctggttcaagttccctggcaccagctccaagattgaacacttcatctccatcctgggcaagtgtttcgactctccatggaccaccagggccctatccgaggtctccggggagaaccagaagggcccagcagccaccgaacgggctgcggccaccatag

SEQ ID NO: 148218 - DNA, 881 bp, Homo sapiens
  Payload ID: 9343
  Gene Symbol: LRRC8E
  Gene Name: leucine rich repeat containing 8 family, member E
  ENST ID: ENST00000599367
  CDS Start-End: 471-881
gagccttggaacgctttcaggcctggtggcggtgggagccggggctggcccagacgctgagtgtctgcagtcagggagcatcgaggcagatgttttcaggccttggtgtcaggggtgggagagggatgcctcgttttggggagggggccacccgaggaggctggagggcggcggccctgtggactatccctcatgtgctcttcgaggtcagacaagtcagatcaggtgcaggggtgcccagaggggaacagtggccgcttggttctgggcaggtggtgacgtctgcatggagggtgactaaggccaggctaagagggaagtgggggcacacactttggtggtttggacaagtttgggcagggagggtcacaggcctgcctgtgtccggctcctcggaggaccccctgcagagcctcccatcctgagggtctctctctacaccccccgtctcgtcccgtcccacaggcagcatgatcccagtggccgagttcaagcagttcacggaacagcagcctgcgttcaaggtgctcaaaccctggtgggacgtgctggccgagtacctcaccgtggccatgctcatgattggggtctttggctgcaccctccaggtgacacaggacaagatcatctgtctacccaatcatgagctccaggagaacttatcagaggccccgtgccagcaattgctgcctcgggggatccctgagcagattggggccctgcaggaggttaaaggccttaagaacaatttggacctgcagcaatacagctttattaaccagctgtgttatgagacggccctgcactggtatgccaagtacttcccttacctcgtggtcattcacacactcatcttcatggtctgcaccagtttctggttc

SEQ ID NO: 148219 - DNA, 555 bp, Homo sapiens
  Payload ID: 9343
  Gene Symbol: LRRC8E
  Gene Name: leucine rich repeat containing 8 family, member E
  ENST ID: ENST00000593511
  CDS Start-End: 270-555
agattgcagtggcacgatctcagctcaccacaacctccgcttcccgggttcaagcgattctcctgcctagctgggactacaggttcatgccaccatgcccggctaatttttgtatttttagaagagacggggtttcaccatgctggccaggctggtttcgaactcctgaccttgtgatccgcctgccttggcctcccaaagtgctgggattacagacgtgagccactgcgcctggcccaacctatgacattttacacttgcatggcagcatgatcccagtggccgagttcaagcagttcacggaacagcagcctgcgttcaaggtgctcaaaccctggtgggacgtgctggccgagtacctcaccgtggccatgctcatgattggggtctttggctgcaccctccaggtgacacaggacaagatcatctgtctacccaatcatgagctccaggagaacttatcagaggccccgtgccagcaattgctgcctcgggggatccctgagcagattggggccctgcaggaggttaaaggccttaagaacaatttggacc

SEQ ID NO: 148220 - DNA, 531 bp, Homo sapiens
  Payload ID: 9343
  Gene Symbol: LRRC8E
  Gene Name: leucine rich repeat containing 8 family, member E
  ENST ID: ENST00000600345
  CDS Start-End: 311-531
gagtcgcggcagctccgctcccagagacccaggagttgggcccagcgtccctcccggaacggtgacacaggacaagatcatctgtctacccaatcatgagctccaggagaacttatcagaggccccgtgccagcaattgctgcctcgggggatccctgagcagattggggccctgcaggaggttaaaggccttaagaacaatttggacctgcagcaatacagctttattaaccagctgtgttatgagacggccctgcactggtatgccaagtacttcccttacctcgtggtcattcacacactcatcttcatggtctgcaccagtttctggttcaagttccctggcaccagctccaagattgaacacttcatctccatcctgggcaagtgtttcgactctccatggaccaccagggccctatccgaggtctccggggagaaccagaagggcccagcagccaccgaacgggctgcggccaccatagtggccatggcagggaccgggccggggaaggcaggggagggtgagaa

SEQ ID NO: 148221 - DNA, 3743 bp, Homo sapiens
  Payload ID: 9343
  Gene Symbol: LRRC8E
  Gene Name: leucine rich repeat containing 8 family, member E
  Uniprot ID: Q6NSJ5
  ENST ID: ENST00000618098
  CDS Start-End: 245-2635
gactcaccctcgcggcccgcccgggaactctgcgggagtcgcggcagctccgctcccagagacccaggagttgggcccagcgtccctcccggaacgaagagacggggtttcaccatgctggccaggctggtttcgaactcctgaccttgtgatccgcctgccttggcctcccaaagtgctgggattacagacgtgagccactgcgcctggcccaacctatgacattttacacttgcatggcagcatgatcccagtggccgagttcaagcagttcacggaacagcagcctgcgttcaaggtgctcaaaccctggtgggacgtgctggccgagtacctcaccgtggccatgctcatgattggggtctttggctgcaccctccaggtgacacaggacaagatcatctgtctacccaatcatgagctccaggagaacttatcagaggccccgtgccagcaattgctgcctcgggggatccctgagcagattggggccctgcaggaggttaaaggccttaagaacaatttggacctgcagcaatacagctttattaaccagctgtgttatgagacggccctgcactggtatgccaagtacttcccttacctcgtggtcattcacacactcatcttcatggtctgcaccagtttctggttcaagttccctggcaccagctccaagattgaacacttcatctccatcctgggcaagtgtttcgactctccatggaccaccagggccctatccgaggtctccggggagaaccagaagggcccagcagccaccgaacgggctgcggccaccatagtggccatggcagggaccgggccggggaaggcaggggagggtgagaaggagaaagtgctggcggaaccggagaaggtggtgaccgagcctccagttgtcaccctgttggacaagaaggagggtgagcaagccaaagccctgtttgagaaggtgaagaagttccgcatgcacgtggaagagggcgacatcctgtacaccatgtacatccgacagacggtgctgaaagtgtgtaagttcctggccatcctggtctacaacctggtctatgtggagaagatcagtttcctggtggcctgtagggtggagacgtcagaggtcacgggctacgccagcttctgctgcaaccacaccaaggcccacctcttctccaagctggccttctgttacatctcctttgtgtgcatctacggacttacctgcatctacacgctctactggctcttccaccggcccctcaaggagtactccttccgttccgtgcgggaggagactggcatgggggacattcctgacgtcaagaatgacttcgccttcatgctgcacctcatcgatcagtacgactccctctactccaagcgcttcgccgtcttcctgtccgaggtcagcgaaagccgtctaaagcagctcaatctcaaccacgagtggacgcccgagaagcttcgacagaagctgcagcgcaatgccgcgggccggctggagctggccctctgcatgctgccgggtctgcccgacaccgtctttgagctcagtgaggtggagtcactcaggctggaggccatctgcgatatcaccttccccccggggctgtcacagctggtgcacttgcaggagctcagcttgctccactcgcccgccaggctacccttctccttgcaggtcttcctgcgggaccacctgaaggtgatgcgcgtcaaatgcgaggagctccgcgaggtgccgctttgggtgtttgggctgcggggcttggaggagctgcacctggaggggcttttcccccaggagctagctcgggcagccaccctggagagcctccgggagctgaagcagctcaaggtgttgtccctccggagcaacgccgggaaggtgccagccagtgtgaccgacgttgctggccacctgcagaggctcagcctgcacaacgatggggcccgtctggttgccctgaacagcctcaagaagctggcggcattgcgggagctggagctggtggcctgcgggctggagcgcatcccccatgcagtgttcagcctgggtgcgctgcaggaacttgacctcaaggacaaccacctgcgctccatcgaggaaatcctcagcttccagcactgccggaagctggtcacgctcaggctgtggcacaaccagatcgcctacgtccctgagcacgtgcggaagctcaggagcctggagcagctctacctcagctacaacaagctggagaccctgccctcccagctcggcctgtgctcaggcctccgtctgctggatgtgtcccacaatgggctacactccctgccacccgaggtgggcctcctgcagaacctacagcacctggccctctcctacaatgccctggaggccctgcccgaagagctcttcttctgccgcaagctgcggacgttgcttctgggcgacaaccagctgagccagctctcgccccacgtgggtgccctcagagccctcagccgcctggagctcaaaggcaaccgcttagaggcgctgccagaagaacttggcaactgtggggggctcaagaaggcggggctcctggtggaagacacgctttaccagggtctgccggcagaagtgcgggacaagatggaggaggaatgaagctggggtggggccgttttaggtagagccttaaaaatgcttctgccctggaatctcaaccattgtcttccaagataggaagccaagtgggtccaggccaggagatggggggggcgggggcagctgtgtcatctttctggggcccaggaggatctgggctggtttgtctggggagacagacaggatgttgtggagctggggtggaacctggtatggagggattaactcagtcatggcattctccgaccaaaaccacacctgtgtctctggcaggctggctggccttgctcccatccctagaactgctgcctctccctggatattccagctcaattagtgccacatatgggggaaacgacacatcccagtgggatttccaacactccccctccccatgcaacaaagcaacttacttctggagttctctcccaaggagaggacacagacacagttgtttgctgtgttatatgttagctccgaacaatggttctcatttggctaagcatcaaaatcacctagggagtcggtgcaaaacaaaatatcccagtcccctcccctgaaacactgactcaggaggtttggttgggggccaggagtctgttcctaaatattccaggtagttctggtgcaggtaagtggccctgagacagtatgttgggaaatgctgacgtaaaggtatcagggccgggcgctgtggctcatgactataatcccagctgtttgagaggccaatgcaggaggatggttgagctcaggagttcgagatcagcctgggtaacatagcgagaccccacctctgccaaaaaaaaaaaaaatagggtatccaaatatctagattctgatcccttttgaggtcctagaccctttgagaaactgatgaagccaggcacctccttcctcaggaaaatgctggtgtacaaatacacacaaagctcttcaggcagctgatagatttcccccagagagctattcaaggacttcctaaggtgggtggactgcagggttaggacacctgctatagaggtgacatttttccaaggacaagcagggactttggtcttgactgttctctgggtgcttaataaataatactaattatgcaagttct

SEQ ID NO: 148222 - DNA, 4717 bp, Homo sapiens
  Payload ID: 9344
  Gene Symbol: LRRC9
  Gene Name: leucine rich repeat containing 9
  Uniprot ID: Q6ZRR7
  ENST ID: ENST00000445360
  CDS Start-End: 205-4566
atcacagggccatgccctcggggctcaaggccagagaggctccgcgcttccaggacccgagagctaaagataatgaatgggagagagcgagactggaggaggtaacgaataagtccccaccaccttgcccataacgcgttgctttcagtcacgttccgcgaactggcgaagttataatattatgatcactgtttttaatggaagatgattgaaagtgaaaacctaaaccaagaagaaataattaaagaactgtgtttgtgcaatggcttatcttatgagatggttggacaagaaggatcagatacatcaaagttggagatgtttttcttagggtatcctcgtatagttggattatcattatttcctaatttaacgagtcttaccattgttgctcaagatataaaagaaatttcagggttagagccttgtttacaacttaaagaactttggattgctgagtgctgcatagagaaaattgaaggtcttcaagaatgtagaaatttggaaaaactatatttatattttaataaaatttccaaaatagaaaatttagagaaattaatcaaattgaaggttctttggctgaaccacaatacaattaaaaatattgagggtttgcaaactttgaagaatttaaaagatctcaaccttgctggaaatctaataaatagcattggtcgatgtcttgactccaatgaacaactggaaagattaaacctttctggtaaccaaatatgttctttcaaggaactcacgaacttaaccaggctgccttgcttaaaggatttatgtctgaatgaccctcaatatacaaccaatccagtttgtcttctgtgtaattattccacacatgtattatatcatttgccttgccttcaaagatttgacacattggatgtgtcagcaaagcaaatcaaggaactggcagataccacagcaatgaaaaaaataatgtattataatatgcgtataaaaactcttcagaggcatcttaaagaagaccttgaaaaactgaatgatcaaaaatgcaaattacaaaagttgccagaagaacgagtaaaattattcagctttgtgaagaaaactttggaacgagaactggctgaactcaagggctcgggcaaagggcacagtgatggatccaataacagtaaagtaactgatcctgaaacactgaagagttgtgaaactgtcactgaagaaccaagtcttcaacagaagatattggccaaactaaatgccttgaatgaaagggtaacattctggaacaaaaaactagatgaaattgaagcaatttatcatattgaagtaaaacaaaagaagaaaagtcatggcttattgatcccacttttgttaattgagttagagactgtgggaaatttccattttgaagaaggcactcgatctgatgactggtttaatttctgctatgaattaattctgtcacgtttttgtgcctgggacttcagaacatacggtattacaggagtaaaagtaaaacgcatcattaaagttaacaaccgtattctgagactaaaattcgaagagaaatttcaaaagtttttggagaatgaagatatgcatgattcagagagctaccgaaggatgctggaatgccttttttatgtttttgatcctgaagtttcagtgaagaaaaagcatcttctacaaatacttgaaaaaggattcaaagacagtgaaacaagcaagctgcctctcaaaaaagaagccatcattgtttctaacagtctaagtataagtgagtgtcccagaattgaatttttacagcaaaagcacaaagatgagaagaaaatctctcttaagcatgagctcttcagacatggcatcctcctcattacaaaagttttccttggccagagtgttcaggcccatgaaaaagaatccatcagtcaatccaactatccaatggttaattcagtgttcattcctcggaaatatttactaaattctgtcatgggacaaagaaactgtgattgcagtgttcggcagtgcaagtggtttgtctttgatcatgaccttgttttgccggaatatgttgttgaatttgagtatattacaatggtcaaggcaccctctttattttctgtattcaacaatgttattctagaagaaagcaaaaaaaacccagaagtatcagtattttccaaggatttgaaatttgatgatgaagttataaaaatggagcccagaatcaaggcccgaccaaaactgattagtttggatgataaaacaatactttcccttgcaaagactagcgtttacagtcatattgtgagtctgaatctacatggaaacagcttgagtaaattgagagatctctccaagttaacaggacttcgaaaactaaacattagctttaatgaatttacctgtttagatgatgtataccacttgtataaccttgaatatttggatgcaagccataaccatgtgataacccttgagggatttagaggtctgatgaaactgaagcacttagacttgagctggaatcaactgaaaaaatctggcaatgaaataaatatgttatgcaaacacaccacaagccttctcactcttgatattcaacataatccatggcaaaagccagccacattgaggctgagtgttattggcagattaaagactcttacccatttaaatggagtcttcatttctgaagaagaagcaacagcagctatgaaatttattgcaggaacaaggattactcagttatctctcttacggcattctagtactaaagaggagagaccacggatacttagtatatggccttctgccaaaattctgacgcaggtttcaaagttaggacctcatttacatctgagtggaaactgctacttgaagataactgccttaaatttagatggacaacatctttttgaaatcacaaatttagaaaaattggaaaatttgaaatgggcatcattcagcaataataatctcactaaaatggagggtctggaatcctgtattaacttggaagagctcacattagatggaaactgcatctcaaagatagaaggtatttccaagatgactaaattaactcgcctcagcataaataataatcttctcactggttgggaagagcatacctttgataacatgcttcatcttcactcgctttctcttgagaacaacagaatcacttcattgagtggtttacaaaaatcttttactcttgttgagttatacataagcaataactatattgctgtcaatcaggagatgcacaatttaaagggtttatgcaacttggtcattctagacatgtgtgggaacatcattatatggaatcaagaaaactaccggttgtttgtaatatttcatcttccagaactgaaagctttggatgggataccaattgaaccatcagagactgacagtgcaaaagatttgtttggtggtagacttacttctgacatgattgcagaacgacaaggacattccaacttcaaacaaatgcaagaactaaattggacttcatcatctattagaacagtggatttgattccagtcgaccaatttagaaatgtgtgtaatgtgaatctacagaacaatcatcttacctcattcagtggattaatctatctacctaatgtgaaggtcttatgccttaactataatcatattgaatcaatcatgcccagactaaagcctcagactcacttaaccagtagacaactactgtaccagaaagtgccttcaagtggctatggacagcaaggaatttcaaaaacaaacagagatataatgagcagtgaaaatttgcctccaataatgcacagtttagaagttcttcatttgggctacaatggaatttgtaatttgatccagctacaacttaacagactaagaaatttaaaattcctctttctacagggtaatgaaatcagccaagttgaagggcttgacaacttagtagtccttcaagaattggtagtggaccataaccgcatccgatcatttaatgacagtgcttttgccaaaccaagttctttattggcacttcacttggaggaaaacagactacgagaactgggcaaattacaatctttggtaaaactagagaaactcttcctaggatataataaaatccaggatatcacagaactggaaaaacttgacgttatctctactctcagggagcttacagtgtatggcaatccaatttgtagaaaaatgctacatcgccacatgcttatatttcgactgcctaacttacagatgttagatggaagtcctgtgaattcagatgatagggcaaaagctgaatttcacctcgctgaactacaagcaaagaaaaactcgcttattcctgttacccactctcctatggatggcagatcatttggccaagtgaaaactcctcccatagagataacaaatgtacttctgcctagtggattcagccattacttgggatctgacgtcactttaactcctgaagttgaagaatttttgggagcaactttccaagatcaaatcgaatgtaactgcctaaagagaaatgagcatacaccaagaaactcacctgtttagtagttgtacaaaaactagcggacagtggtcagttaaaaaaaaaaaaaaaagataatcatgttacttaagttactgaagcacttcagttccatatgaagataatctattacccttcatgaacttgatttaatatcacctctcttaaactttc

SEQ ID NO: 148223 - DNA, 4915 bp, Homo sapiens
  Payload ID: 9344
  Gene Symbol: LRRC9
  Gene Name: leucine rich repeat containing 9
  Uniprot ID: Q6ZRR7
  ENST ID: ENST00000254271
  CDS Start-End: 205-3540
atcacagggccatgccctcggggctcaaggccagagaggctccgcgcttccaggacccgagagctaaagataatgaatgggagagagcgagactggaggaggtaacgaataagtccccaccaccttgcccataacgcgttgctttcagtcacgttccgcgaactggcgaagttataatattatgatcactgtttttaatggaagatgattgaaagtgaaaacctaaaccaagaagaaataattaaagaactgtgtttgtgcaatggcttatcttatgagatggttggacaagaaggatcagatacatcaaagttggagatgtttttcttagggtatcctcgtatagttggattatcattatttcctaatttaacgagtcttaccattgttgctcaagatataaaagaaatttcagggttagagccttgtttacaacttaaagaactttggattgctgagtgctgcatagagaaaattgaaggtcttcaagaatgtagaaatttggaaaaactatatttatattttaataaaatttccaaaatagaaaatttagagaaattaatcaaattgaaggttctttggctgaaccacaatacaattaaaaatattgagggtttgcaaactttgaagaatttaaaagatctcaaccttgctggaaatctaataaatagcattggtcgatgtcttgactccaatgaacaactggaaagattaaacctttctggtaaccaaatatgttctttcaaggaactcacgaacttaaccaggctgccttgcttaaaggatttatgtctgaatgaccctcaatatacaaccaatccagtttgtcttctgtgtaattattccacacatgtattatatcatttgccttgccttcaaagatttgacacattggatgtgtcagcaaagcaaatcaaggaactggcagataccacagcaatgaaaaaaataatgtattataatatgcgtataaaaactcttcagaggcatcttaaagaagaccttgaaaaactgaatgatcaaaaatgcaaattacaaaagttgccagaagaacgagtaaaattattcagctttgtgaagaaaactttggaacgagaactggctgaactcaagggctcgggcaaagggcacagtgatggatccaataacagtaaagtaactgatcctgaaacactgaagagttgtgaaactgtcactgaagaaccaagtcttcaacagaagatattggccaaactaaatgccttgaatgaaagggtaacattctggaacaaaaaactagatgaaattgaagcaatttatcatattgaagtaaaacaaaagaagaaaagtcatggcttattgatcccacttttgttaattgagttagagactgtgggaaatttccattttgaagaaggcactcgatctgatgactggtttaatttctgctatgaattaattctgtcacgtttttgtgcctgggacttcagaacatacggtattacaggagtaaaagtaaaacgcatcattaaagttaacaaccgtattctgagactaaaattcgaagagaaatttcaaaagtttttggagaatgaagatatgcatgattcagagagctaccgaaggatgctggaatgccttttttatgtttttgatcctgaagtttcagtgaagaaaaagcatcttctacaaatacttgaaaaaggattcaaagacagtgaaacaagcaagctgcctctcaaaaaagaagccatcattgtttctaacagtctaagtataagtgagtgtcccagaattgaatttttacagcaaaagcacaaagatgagaagaaaatctctcttaagcatgagctcttcagacatggcatcctcctcattacaaaagttttccttggccagagtgttcaggcccatgaaaaagaatccatcagtcaatccaactatccaatggttaattcagtgttcattcctcggaaatatttactaaattctgtcatgggacaaagaaactgtgattgcagtgttcggcagtgcaagtggtttgtctttgatcatgaccttgttttgccggaatatgttgttgaatttgagtatattacaatggtcaaggcaccctctttattttctgtattcaacaatgttattctagaagaaagcaaaaaaaacccagaagtatcagtattttccaaggatttgaaatttgatgatgaagttataaaaatggagcccagaatcaaggcccgaccaaaactgattagtttggatgataaaacaatactttcccttgcaaagactagcgtttacagtcatattgtgagtctgaatctacatggaaacagcttgagtaaattgagagatctctccaagttaacaggacttcgaaaactaaacattagctttaatgaatttacctgtttagatgatgtataccacttgtataaccttgaatatttggatgcaagccataaccatgtgataacccttgagggatttagaggtctgatgaaactgaagcacttagacttgagctggaatcaactgaaaaaatctggcaatgaaataaatatgttatgcaaacacaccacaagccttctcactcttgatattcaacataatccatggcaaaagccagccacattgaggctgagtgttattggcagattaaagactcttacccatttaaatggagtcttcatttctgaagaagaagcaacagcagctatgaaatttattgcaggaacaaggattactcagttatctctcttacggcattctagtactaaagaggagagaccacggatacttagtatatggccttctgccaaaattctgacgcaggtttcaaagttaggacctcatttacatctgagtggaaactgctacttgaagataactgccttaaatttagatggacaacatctttttgaaatcacaaatttagaaaaattggaaaatttgaaatgggcatcattcagcaataataatctcactaaaatggagggtctggaatcctgtattaacttggaagagctcacattagatggaaactgcatctcaaagatagaaggtatttccaagatgactaaattaactcgcctcagcataaataataatcttctcactggttgggaagagcatacctttgataacatgcttcatcttcactcgctttctcttgagaacaacagaatcacttcattgagtggtttacaaaaatcttttactcttgttgagttatacataagcaataactatattgctgtcaatcaggagatgcacaatttaaagggtttatgcaacttggtcattctagacatgtgtgggaacatcattatatggaatcaagaaaactaccggttgtttgtaatatttcatcttccagaactgaaagctttggatgggataccaattgaaccatcagagactgacagtgcaaaagatttgtttggtggtagacttacttctgacatgattgcagaacgacaaggacattccaacttcaaacaaatgcaagaactaaattggacttcatcatctattagctgtatttactttgtctaaattcagaacagtggatttgattccagtcgaccaatttagaaatgtgtgtaatgtgaatctacagaacaatcatcttacctcattcagtggattaatctatctacctaatgtgaaggtcttatgccttaactataatcatattgaatcaatcatgcccagactaaagcctcagactcacttaaccagtagacaactactgtaccagaaagtgccttcaagtggctatggacagcaaggaatttcaaaaacaaacagagatataatgagcagtgaaaatttgcctccaataatgcacagtttagaagttcttcatttgggctacaatggaatttgtaatttgatccagctacaacttaacagactaagaaatttaaaattcctctttctacagggtaatgaaatcagccaagttgaagggcttgacaacttagtagtccttcaagaattggtagtggaccataaccgcatccgatcatttaatgacagtgcttttgccaaaccaagttctttattggcacttcacttggaggaaaacagactacgagaactgggcaaattacaatctttggtaaaactagagaaactcttcctaggatataataaaatccaggatatcacagaactggaaaaacttgacgttatctctactctcagggagcttacagtgtatggcaatccagtgaatttgtagaaaaatgctacatcgccacatgcttatatttcgactgcctaacttacagatgttagatggaagtcctgtgaattcagatgatagggcaaaagctgaatttcacctcgctgaactacaagcaaagaaaaactcgcttattcctgttacccactctcctatggatggcagatcatttggccaagtgaaaactcctcccatagagataacaaatgtacttctgcctagtggattcagccattacttgggatctgacgtcactttaactcctgaagttgaagacaaaaaaaacaagaatgctgggattctgacaaataatcctcggagcatccatgcagaaatagcttttcggcaactcagagggataagtatctctccatctcttttatcacatcagaatattgcatctcctactgcacaaatataccagagcaaccaagataagagaagaatttttgggagcaactttccaagatcaaatcgaatgtaactgcctaaagagaaatgagcatacaccaagaaactcacctgtttagtagttgtacaaaaactagcggacagtggtcagttaaaaaaaaaaaaaaaagataatcatgttacttaagttactgaagcacttcagttccatatgaagataatctattacccttcatgaacttgatttaatatcacctctcttaaactttc

SEQ ID NO: 148224 - DNA, 799 bp, Homo sapiens
  Payload ID: 9344
  Gene Symbol: LRRC9
  Gene Name: leucine rich repeat containing 9
  ENST ID: ENST00000568404
  CDS Start-End: 1-337
tttggtaaaactagagaaactcttcctaggatataataaaatccaggatatcacagaactggaaaaacttgacgttatctctactctcagggagcttacagtgtatggcaatccaatttgtagaaaaatgctacatcgccacatgcttatatttcgactgcctaacttacagatgttagatggaagtcctgtgaattcagatgatagggcaaaagctgaatttcacctcgctgaactacaagcaaagaaaaactcgagaagtaacattattagaatgctgtggtttgagaaaaaaagaggctggagggagaagggaaaccagctcagaggcttttagaataatccaagagagatgttatgaagacctggaccacggtagagaatataaatgaatctttgatcttattcctgttacccactctcctatggatggcagatcatttggccaagtgaaaactcctcccatagagataacaaatgtacttctgcctagtggattcagccattacttgggatctgacgtcactttaactcctgaagttgaagacaaaaaaaacaagaatgctgggattctgacaaataatcctcggagcatccatgcagaaatagcttttcggcaactcagagggataagtatctctccatctcttttatcacatcagaatattgcatctcctactgcacaaatataccagagcaaccaagataagagaagaatttttgggagcaactttccaagatcaaatcgaatgtaactgcctaaagagaaatgagcatacaccaagaaactcacctgttt

SEQ ID NO: 148225 - DNA, 500 bp, Homo sapiens
  Payload ID: 9344
  Gene Symbol: LRRC9
  Gene Name: leucine rich repeat containing 9
  ENST ID: ENST00000570145
  CDS Start-End: 159-500
gtacacaccaggcctggggcgggagagggtttcctaccttctgctgcaagacagggattgggaaatcggagtggactcggacttgaatcggattgccccggaatccaccctctctctgtgataagttataatattatgatcactgtttttaatggaagatgattgaaagtgaaaacctaaaccaagaagaaataattaaagaactgtgtttgtgcaatggcttatcttatgagatggttggacaagaaggatcagatacatcaaagttggagatgtttttcttagggtatcctcgtatagttggattatcattatttcctaatttaacgagtcttaccattgttgctcaagatataaaagaaatttcagggttagagccttgtttacaacttaaagaactttggattgctgagtgctgcatagagaaaattgaaggtcttcaagaatgtagaaatttggaaaaactatatttatattttaataaaatttccaaaatagaa

SEQ ID NO: 148226 - DNA, 3823 bp, Homo sapiens
  Payload ID: 9345
  Gene Symbol: LRRN1
  Gene Name: leucine rich repeat neuronal 1
  Uniprot ID: Q6UXK5
  ENST ID: ENST00000319331
  CDS Start-End: 762-2912
aaagcggggcgcaccgcgggcgccggcaacgagccggtgaacgaggcgaggcccgtgcgcccgcggctgcaagcgcccgcctggcggggagaggggccgacggcgtcagcccgggcggcggcatccctaggcgcctggggcgccttcctccggacctggccgctcgctgccccgccctctgcaccccacttctccgaccctccttcccagtcctgcctccccctgccctggcctctgagagccgactgagcccagccccgtgcagcagcggttgcctgtgtcgccgcctagtctccggtcttggtgctctcccgggggtgccccaaggagccagtgcgcgctgcgggctgggaaggaggcgccgctcagctagtcctcctcctcctcctcgtctttctcctcctcctgctgctgctgccgccgccgccgccgtgggtgccgggtccgcgcgcaccccaacacccccaccagctgggcctcggggcacatctccagacttcaatttggctgaaataattcatgccacggacctgtgcacatgcctggaattgagagacacagttaaaagactccaagttgctttctgccttttgaaaactcctgaaaaccatccctttggactctggaattctacacagctcaaccaagactttgcttgaatgtttacattttctgctcgctgtcctacatatcacaatatagtgttcacgttttgttaaaactttggggtgtcaggagttgagcttgctcagcaagccagcatggctaggatgagctttgttatagcagcttgccaattggtgctgggcctactaatgacttcattaaccgagtcttccatacagaatagtgagtgtccacaactttgcgtatgtgaaattcgtccctggtttaccccacagtcaacttacagagaagccaccactgttgattgcaatgacctccgcttaacaaggattcccagtaacctctctagtgacacacaagtgcttctcttacagagcaataacatcgcaaagactgtggatgagctgcagcagcttttcaacttgactgaactagatttctcccaaaacaactttactaacattaaggaggtcgggctggcaaacctaacccagctcacaacgctgcatttggaggaaaatcagattaccgagatgactgattactgtctacaagacctcagcaaccttcaagaactctacatcaaccacaaccaaattagcactatttctgctcatgcttttgcaggcttaaaaaatctattaaggctccacctgaactccaacaaattgaaagttattgatagtcgctggtttgattctacacccaacctggaaattctcatgatcggagaaaaccctgtgattggaattctggatatgaacttcaaacccctcgcaaatttgagaagcttagttttggcaggaatgtatctcactgatattcctggaaatgctttggtgggtctggatagccttgagagcctgtctttttatgataacaaactggttaaagtccctcaacttgccctgcaaaaagttccaaatttgaaattcttagacctcaacaaaaaccccattcacaaaatccaagaaggggacttcaaaaatatgcttcggttaaaagaactgggaatcaacaatatgggcgagctcgtttctgtcgaccgctatgccctggataacttgcctgaactcacaaagctggaagccaccaataaccctaaactctcttacatccaccgcttggctttccgaagtgtccctgctctggaaagcttgatgctgaacaacaatgccttgaatgccatttaccaaaagacagtcgaatccctccccaatctgcgtgagatcagtatccatagcaatcccctcaggtgtgactgtgtgatccactggattaactccaacaaaaccaacatccgcttcatggagcccctgtccatgttctgtgccatgccgcccgaatataaagggcaccaggtgaaggaagttttaatccaggattcgagtgaacagtgcctcccaatgatatctcacgacagcttcccaaatcgtttaaacgtggatatcggcacgacggttttcctagactgtcgagccatggctgagccagaacctgaaatttactgggtcactcccattggaaataagataactgtggaaaccctttcagataaatacaagctaagtagcgaaggtaccttggaaatatctaacatacaaattgaagactcaggaagatacacatgtgttgcccagaatgtccaaggggcagacactcgggtggcaacaattaaggttaatgggacccttctggatggtacccaggtgctaaaaatatacgtcaagcagacagaatcccattccatcttagtgtcctggaaagttaattccaatgtcatgacgtcaaacttaaaatggtcgtctgccaccatgaagattgataaccctcacataacatatactgccagggtcccagtcgatgtccatgaatacaacctaacgcatctgcagccttccacagattatgaagtgtgtctcacagtgtccaatattcatcagcagactcaaaagtcatgcgtaaatgtcacaaccaaaaatgccgccttcgcagtggacatctctgatcaagaaaccagtacagcccttgctgcagtaatggggtctatgtttgccgtcattagccttgcgtccattgctgtgtactttgccaaaagatttaagagaaaaaactaccaccactcattaaaaaagtatatgcaaaaaacctcttcaatcccactaaatgagctgtacccaccactcattaacctctgggaaggtgacagcgagaaagacaaagatggttctgcagacaccaagccaacccaggtcgacacatccagaagctattacatgtggtaactcagaggatattttgcttctggtagtaaggagcacaaagacgtttttgctttattctgcaaaagtgaacaagttgaagacttttgtatttttgactttgctagtttgtggcagagtggagaggacgggtggatatttcaaatttttttagtatagcgtatcgcaagggtttgacacggctgccagcgactctaggcttccagtctgtgtttggtttttattcttatcattattatgattgttattatattattattttattttagttgttgtgctaaactcaataatgctgttctaactacagtgctcaataaaatgattaatgacaggatggggttcccctgtgcttttaccagtagcatgaccccttctgaagccatccgtagaaagtactttgtcctccaaaaagctaacatacggttttgaagcagcattgaaacttttgtagcaatctggtctatagacttttaactcaagaagctaaggctagacttgttaccttcgttgaatgatgttagttgactgtactgtaatgttgtatcaactgaattgaatgtttgcctttaaacaatgaattttctttttctttccttttttttttttttgttgtaatagttaaagaggcttagaacaagctaacaggcaatagaaatatgtatatcagattttttaatgtaacaaactacatgttaattgttatcttattctttttatctttagtagacacttttaaaagaaaagacaagtttgttgtgtttaactcaccaacacgtggtgtataatgaagacagaactataataaattagttttgttctgattttttagaacacttgcaataatgtatcatttatagttcttgctagttgcagtggtaatatttttcacatccataaaaacaactaccaaaata

SEQ ID NO: 148227 - DNA, 5036 bp, Homo sapiens
  Payload ID: 9346
  Gene Symbol: LRRN2
  Gene Name: leucine rich repeat neuronal 2
  Uniprot ID: O75325
  ENST ID: ENST00000367175
  CDS Start-End: 2214-4355
gaacaggcacagggcctgcagctgcagcattcagtgcatcccagaccctccagaggcccagggcagggtcagatcagacagacctggcagcacagatgtgaagtgtaaacggcacacagccccctggacttgggttgattcttgtatcttgctgctcaccagctatgtgacttgagccaagttctttaacctcttcaggacctcagtctcttaatctgcaaactggaggtattagtgcttatctcatgtacctgttatgagagtcatatgaaaaaagacattcagagtcttcaaagagtcctgagcaatggtaggtgctcagtaagtgtttgtgcatttccttgacacttgtagctaaaaacttacctggaatcagacttccactcaggagtcagaccaggctcaagaaggcaacacagtctggcccctttttgtttccatctttggttctaggccaaggctggacttgcctcatggccctggcatctgagagagaaactggataggttcctcatgctcaggatggaggaaacagcagtggcttgcattgttgattgcaggggtgatgtctaatctcctgaagaaaggaactctggagtcacagagattgattcatacaatcaacacacactgggcacccatcccgtactacaggcacaagaggcaagacaggtctctagttagagacgttttcccacggtgtggtcagaactgtgacagtaggaagcatgagtactgcaagagcataaagccagccccttagtcagccaggtggggaggttttggagaagacttctgcaggtggtgactgaacttaaagttgagcgttgaagaacaagtaggagttgtctggaagacaatgaggaggagacatcagaaggggtggcatgtcacggtaacctcaacccaaaaggtttgtgtgcagcgggtaagtggggtggtgacaagagaagccaggtgaaggggccgggccaggtcacagaaggtcttacctgcacagctgaggagctcagacccaggcttcttaactccactgcctcctcctgggcaacactgccaggctgttgggaaaggagaaacactcctgcctccagggtggggaagttggcaaacaccaaagcaatatccccacccagaagatcctgggcagcagaacaccccagcctgcctggatgtgtcaggtctgctgcctttcacctctagggtcctggggagcccatcccagattttagaagctgtacttatttccaccaaccctcacccacctcccacctacactgccagaggaacttctggaaacttatcattttatcttccatttacccagtgagccaaggaggctgggaggaaagaggtaagaaaggttagagaacctacctcacatctctctgggctcagaaggactctgaagataacaataatttcagcccatccactctccttccctcccaaacacacatgtgcatgtacacacacacatacacacacatacaccttcctctccttcactgaagactcacagtcactcactctgtgagcaggtcatagaaaaggacactaaagccttaaggacaggcctggccattacctctgcagctcctttggcttgttgagtcaaaaaacatgggaggggccaggcacggtgactcacacctgtaatcccagcattttgggagaccgaggtgagcagatcacttgaggtcaggagttcgagaccagcctggccaacatggagaaacccccatctctactaaaaatacaaaaattagccaggagtggtggcaggtgcctgtaatcccagctactcaggtggctgagccaggagaatcgcttgaatccaggaggcggaggatgcagtcagctgagtgcaccgctgcactccagcctgggtgacagaatgagactctgtctcaaacaaacaaacacgggaggaggggtagatactgcttctctgcaacctccttaactctgcatcctcttcttccagggctgcccctgatggggcctggcaatgactgagcaggcccagccccagaggacaaggaagagaaggcatattgaggagggcaagaagtgacgcccggtgtagaatgactgccctgggagggtggttccttgggccctggcagggttgctgacccttaccctgcaaaacacaaagagcaggactccagactcttcttgtgaatggtcccctgccctgcagctccaccatgaggcttctcgtggccccactcttgctagcttgggtggctggtgccactgccgctgtgcccgtggtaccctggcatgttccctgcccccctcagtgtgcctgccagatccggccctggtatacgccccgctcgtcctaccgcgaggctaccactgtggactgcaatgacctattcctgacggcagtccccccggcactccccgcaggcacacagaccctgctcctgcagagcaacagcattgtccgtgtggaccagagtgagctgggctacctggccaatctcacagagctggacctgtcccagaacagcttttcggatgcccgagactgtgatttccatgccctgccccagctgctgagcctgcacctagaggagaaccagctgacccggctggaggaccacagctttgcagggctggccagcctacaggaactctatctcaaccacaaccagctctaccgcatcgcccccagggccttttctggcctcagcaacttgctgcggctgcacctcaactccaacctcctgagggccattgacagccgctggtttgaaatgctgcccaacttggagatactcatgattggcggcaacaaggtagatgccatcctggacatgaacttccggcccctggccaacctgcgtagcctggtgctagcaggcatgaacctgcgggagatctccgactatgccctggaggggctgcaaagcctggagagcctctccttctatgacaaccagctggcccgggtgcccaggcgggcactggaacaggtgcccgggctcaagttcctagacctcaacaagaacccgctccagcgggtagggccgggggactttgccaacatgctgcaccttaaggagctgggactgaacaacatggaggagctggtctccatcgacaagtttgccctggtgaacctccccgagctgaccaagctggacatcaccaataacccacggctgtccttcatccacccccgcgccttccaccacctgccccagatggagaccctcatgctcaacaacaacgctctcagtgccttgcaccagcagacggtggagtccctgcccaacctgcaggaggtaggtctccacggcaaccccatccgctgtgactgtgtcatccgctgggccaatgccacgggcacccgtgtccgcttcatcgagccgcaatccaccctgtgtgcggagcctccggacctccagcgcctcccggtccgtgaggtgcccttccgggagatgacggaccactgtttgcccctcatctccccacgaagcttccccccaagcctccaggtagccagtggagagagcatggtgctgcattgccgggcactggccgaacccgaacccgagatctactgggtcactccagctgggcttcgactgacacctgcccatgcaggcaggaggtaccgggtgtaccccgaggggaccctggagctgcggagggtgacagcagaagaggcagggctatacacctgtgtggcccagaacctggtgggggctgacactaagacggttagtgtggttgtgggccgtgctctcctccagccaggcagggacgaaggacaggggctggagctccgggtgcaggagacccacccctatcacatcctgctatcttgggtcaccccacccaacacagtgtccaccaacctcacctggtccagtgcctcctccctccggggccagggggccacagctctggcccgcctgcctcggggaacccacagctacaacattacccgcctccttcaggccacggagtactgggcctgcctgcaagtggcctttgctgatgcccacacccagttggcttgtgtatgggccaggaccaaagaggccacttcttgccacagagccttaggggaccgtcctgggctcattgccatcctggctctcgctgtccttctcctggcagctgggctagcggcccaccttggcacaggccaacccaggaagggtgtgggtgggaggcggcctctccctccagcctgggctttctggggctggagtgccccttctgtccgggttgtgtctgctcccctcgtcctgccctggaatccagggaggaagctgcccagatcctcagaaggggagacactgttgccaccattgtctcaaaattcttgaagctcagcctgttctcagcagtagagaaatcactaggactactttttaccaaaagagaagcagtctgggccagatgccctgccaggaaagggacatggacccacgtgcttgaggcctggcagctgggccaagacagatggggctttgtggccctgggggtgcttctgcagcctcgaaaaagttgcccttacctcctagggtcacctctgctgccattctgaggaacatctccaaggaacaggagggactttggctagagcctcctgcctccccatcttctctctgcccagaggctcctgggcctggcttggctgtcccctacctgtgtccccgggctgcaccccttcctcttctctttctctgtacagtctcagttgcttgctcttgtgcctcctgggcaagggctgaaggaggccactccatctcacctcggggggctgccctcaatgtgggagtgaccccagccagatctgaaggacatttgggagagggatgcccaggaacgcctcatctcagcagcctgggctcggcattccgaagctgactttctataggcaattttgtacctttgtggagaaatgtgtcacctcccccaacccgattcactcttttctcctgttttgtaaaaaataaaaataaataataacaataatacgggggaaaggaacgaaaggaaaataa

SEQ ID NO: 148228 - DNA, 3211 bp, Homo sapiens
  Payload ID: 9346
  Gene Symbol: LRRN2
  Gene Name: leucine rich repeat neuronal 2
  Uniprot ID: O75325
  ENST ID: ENST00000367176
  CDS Start-End: 389-2530
cagcagacggcagacggtgcccggcgcccacgggaagctgaagatacagcggtaaacaaacctccatgtctcaagctgaccacacttgtatctggacttgccagctgattagctctgttcccaccaggctcgttcaaagacccacagcttgagggggcagagggctgcccctgatggggcctggcaatgactgagcaggcccagccccagaggacaaggaagagaaggcatattgaggagggcaagaagtgacgcccggtgtagaatgactgccctgggagggtggttccttgggccctggcagggttgctgacccttaccctgcaaaacacaaagagcaggactccagactcttcttgtgaatggtcccctgccctgcagctccaccatgaggcttctcgtggccccactcttgctagcttgggtggctggtgccactgccgctgtgcccgtggtaccctggcatgttccctgcccccctcagtgtgcctgccagatccggccctggtatacgccccgctcgtcctaccgcgaggctaccactgtggactgcaatgacctattcctgacggcagtccccccggcactccccgcaggcacacagaccctgctcctgcagagcaacagcattgtccgtgtggaccagagtgagctgggctacctggccaatctcacagagctggacctgtcccagaacagcttttcggatgcccgagactgtgatttccatgccctgccccagctgctgagcctgcacctagaggagaaccagctgacccggctggaggaccacagctttgcagggctggccagcctacaggaactctatctcaaccacaaccagctctaccgcatcgcccccagggccttttctggcctcagcaacttgctgcggctgcacctcaactccaacctcctgagggccattgacagccgctggtttgaaatgctgcccaacttggagatactcatgattggcggcaacaaggtagatgccatcctggacatgaacttccggcccctggccaacctgcgtagcctggtgctagcaggcatgaacctgcgggagatctccgactatgccctggaggggctgcaaagcctggagagcctctccttctatgacaaccagctggcccgggtgcccaggcgggcactggaacaggtgcccgggctcaagttcctagacctcaacaagaacccgctccagcgggtagggccgggggactttgccaacatgctgcaccttaaggagctgggactgaacaacatggaggagctggtctccatcgacaagtttgccctggtgaacctccccgagctgaccaagctggacatcaccaataacccacggctgtccttcatccacccccgcgccttccaccacctgccccagatggagaccctcatgctcaacaacaacgctctcagtgccttgcaccagcagacggtggagtccctgcccaacctgcaggaggtaggtctccacggcaaccccatccgctgtgactgtgtcatccgctgggccaatgccacgggcacccgtgtccgcttcatcgagccgcaatccaccctgtgtgcggagcctccggacctccagcgcctcccggtccgtgaggtgcccttccgggagatgacggaccactgtttgcccctcatctccccacgaagcttccccccaagcctccaggtagccagtggagagagcatggtgctgcattgccgggcactggccgaacccgaacccgagatctactgggtcactccagctgggcttcgactgacacctgcccatgcaggcaggaggtaccgggtgtaccccgaggggaccctggagctgcggagggtgacagcagaagaggcagggctatacacctgtgtggcccagaacctggtgggggctgacactaagacggttagtgtggttgtgggccgtgctctcctccagccaggcagggacgaaggacaggggctggagctccgggtgcaggagacccacccctatcacatcctgctatcttgggtcaccccacccaacacagtgtccaccaacctcacctggtccagtgcctcctccctccggggccagggggccacagctctggcccgcctgcctcggggaacccacagctacaacattacccgcctccttcaggccacggagtactgggcctgcctgcaagtggcctttgctgatgcccacacccagttggcttgtgtatgggccaggaccaaagaggccacttcttgccacagagccttaggggaccgtcctgggctcattgccatcctggctctcgctgtccttctcctggcagctgggctagcggcccaccttggcacaggccaacccaggaagggtgtgggtgggaggcggcctctccctccagcctgggctttctggggctggagtgccccttctgtccgggttgtgtctgctcccctcgtcctgccctggaatccagggaggaagctgcccagatcctcagaaggggagacactgttgccaccattgtctcaaaattcttgaagctcagcctgttctcagcagtagagaaatcactaggactactttttaccaaaagagaagcagtctgggccagatgccctgccaggaaagggacatggacccacgtgcttgaggcctggcagctgggccaagacagatggggctttgtggccctgggggtgcttctgcagcctcgaaaaagttgcccttacctcctagggtcacctctgctgccattctgaggaacatctccaaggaacaggagggactttggctagagcctcctgcctccccatcttctctctgcccagaggctcctgggcctggcttggctgtcccctacctgtgtccccgggctgcaccccttcctcttctctttctctgtacagtctcagttgcttgctcttgtgcctcctgggcaagggctgaaggaggccactccatctcacctcggggggctgccctcaatgtgggagtgaccccagccagatctgaaggacatttgggagagggatgcccaggaacgcctcatctcagcagcctgggctcggcattccgaagctgactttctataggcaattttgtacctttgtggagaaatgtgtcacctcccccaacccgattcactcttttctcctgttttgtaaaaaataaaaataaataataacaataatacgggggaaaggaacgaaaggaaaataa

SEQ ID NO: 148229 - DNA, 3463 bp, Homo sapiens
  Payload ID: 9346
  Gene Symbol: LRRN2
  Gene Name: leucine rich repeat neuronal 2
  Uniprot ID: O75325
  ENST ID: ENST00000367177
  CDS Start-End: 641-2782
gggagagcggcggagaagcgagtgaggagggcgagcgcgaagccgggaagaggggcgcgcgtggagggggtgccgggcgccgcgagggcctgctccgggcacctgcgaacgcgcggcgctctcaaggagcgcctggctctcgcccgccagcctccggccgcgacgcgcccagggcgcggagagggggtggggacggattgggattctgccatcgccctcaccggctgggccctggagccgctcccaggataactccacgttggggagggcgcccgccgagcctccccggcctgtgcagacggcgcgcgcggcgggagggcgcggaccagcgtccccagcccggccccgggcggaaggcgagcggagcgcggccgcgcgggcagcagacggcagacggtgcccggcgcccacgggggctgcccctgatggggcctggcaatgactgagcaggcccagccccagaggacaaggaagagaaggcatattgaggagggcaagaagtgacgcccggtgtagaatgactgccctgggagggtggttccttgggccctggcagggttgctgacccttaccctgcaaaacacaaagagcaggactccagactcttcttgtgaatggtcccctgccctgcagctccaccatgaggcttctcgtggccccactcttgctagcttgggtggctggtgccactgccgctgtgcccgtggtaccctggcatgttccctgcccccctcagtgtgcctgccagatccggccctggtatacgccccgctcgtcctaccgcgaggctaccactgtggactgcaatgacctattcctgacggcagtccccccggcactccccgcaggcacacagaccctgctcctgcagagcaacagcattgtccgtgtggaccagagtgagctgggctacctggccaatctcacagagctggacctgtcccagaacagcttttcggatgcccgagactgtgatttccatgccctgccccagctgctgagcctgcacctagaggagaaccagctgacccggctggaggaccacagctttgcagggctggccagcctacaggaactctatctcaaccacaaccagctctaccgcatcgcccccagggccttttctggcctcagcaacttgctgcggctgcacctcaactccaacctcctgagggccattgacagccgctggtttgaaatgctgcccaacttggagatactcatgattggcggcaacaaggtagatgccatcctggacatgaacttccggcccctggccaacctgcgtagcctggtgctagcaggcatgaacctgcgggagatctccgactatgccctggaggggctgcaaagcctggagagcctctccttctatgacaaccagctggcccgggtgcccaggcgggcactggaacaggtgcccgggctcaagttcctagacctcaacaagaacccgctccagcgggtagggccgggggactttgccaacatgctgcaccttaaggagctgggactgaacaacatggaggagctggtctccatcgacaagtttgccctggtgaacctccccgagctgaccaagctggacatcaccaataacccacggctgtccttcatccacccccgcgccttccaccacctgccccagatggagaccctcatgctcaacaacaacgctctcagtgccttgcaccagcagacggtggagtccctgcccaacctgcaggaggtaggtctccacggcaaccccatccgctgtgactgtgtcatccgctgggccaatgccacgggcacccgtgtccgcttcatcgagccgcaatccaccctgtgtgcggagcctccggacctccagcgcctcccggtccgtgaggtgcccttccgggagatgacggaccactgtttgcccctcatctccccacgaagcttccccccaagcctccaggtagccagtggagagagcatggtgctgcattgccgggcactggccgaacccgaacccgagatctactgggtcactccagctgggcttcgactgacacctgcccatgcaggcaggaggtaccgggtgtaccccgaggggaccctggagctgcggagggtgacagcagaagaggcagggctatacacctgtgtggcccagaacctggtgggggctgacactaagacggttagtgtggttgtgggccgtgctctcctccagccaggcagggacgaaggacaggggctggagctccgggtgcaggagacccacccctatcacatcctgctatcttgggtcaccccacccaacacagtgtccaccaacctcacctggtccagtgcctcctccctccggggccagggggccacagctctggcccgcctgcctcggggaacccacagctacaacattacccgcctccttcaggccacggagtactgggcctgcctgcaagtggcctttgctgatgcccacacccagttggcttgtgtatgggccaggaccaaagaggccacttcttgccacagagccttaggggaccgtcctgggctcattgccatcctggctctcgctgtccttctcctggcagctgggctagcggcccaccttggcacaggccaacccaggaagggtgtgggtgggaggcggcctctccctccagcctgggctttctggggctggagtgccccttctgtccgggttgtgtctgctcccctcgtcctgccctggaatccagggaggaagctgcccagatcctcagaaggggagacactgttgccaccattgtctcaaaattcttgaagctcagcctgttctcagcagtagagaaatcactaggactactttttaccaaaagagaagcagtctgggccagatgccctgccaggaaagggacatggacccacgtgcttgaggcctggcagctgggccaagacagatggggctttgtggccctgggggtgcttctgcagcctcgaaaaagttgcccttacctcctagggtcacctctgctgccattctgaggaacatctccaaggaacaggagggactttggctagagcctcctgcctccccatcttctctctgcccagaggctcctgggcctggcttggctgtcccctacctgtgtccccgggctgcaccccttcctcttctctttctctgtacagtctcagttgcttgctcttgtgcctcctgggcaagggctgaaggaggccactccatctcacctcggggggctgccctcaatgtgggagtgaccccagccagatctgaaggacatttgggagagggatgcccaggaacgcctcatctcagcagcctgggctcggcattccgaagctgactttctataggcaattttgtacctttgtggagaaatgtgtcacctcccccaacccgattcactcttttctcctgttttgtaaaaaataaaaataaataataacaataatacgggggaaaggaacgaaaggaaaataa

SEQ ID NO: 148230 - DNA, 3099 bp, Homo sapiens
  Payload ID: 9347
  Gene Symbol: LRRN3
  Gene Name: leucine rich repeat neuronal 3
  Uniprot ID: Q9H3W5
  ENST ID: ENST00000308478
  CDS Start-End: 940-3066
tttcagccaaccagactggagcagctgcgagtgctacatcttggctgtctgaagcgattggctcctctctggggagtggagggtgttcagttattaatgaccgctgagcaggcagcaccatgtcagtgtgacaactgatcgggtgaacgatgcaccactaaccaccatggaaacaaggaaaaataaagccagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacctatttataccgggcaagaacacaaccatgtgattatctcaaccaaggaactgaggaatccagcacgcaaggacatcggaggtgggctagcactgaaactgcttttcaagacgaggaagaggaggagaaagagaaagaagaggaagatgttgggcaacatttatttaacatgctccacagcccggaccctggcatcatgctgctattcctgcaaatactgaagaagcatgggatttaaatattttacttctaaataaatgaattactcaatctcctatgaccatctatacatactccaccttcaaaaagtacatcaatattatatcattaaggaaatagtaaccttctcttctccaatatgcatgacatttttggacaatgcaattgtggcactggcacttatttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatgaaggacatgccactccgaattcatgtgctacttggcctagctatcactacactagtacaagctgtagataaaaaagtggattgtccacggttatgtacgtgtgaaatcaggccttggtttacacccagatccatttatatggaagcatctacagtggattgtaatgatttaggtcttttaactttcccagccagattgccagctaacacacagattcttctcctacagactaacaatattgcaaaaattgaatactccacagactttccagtaaaccttactggcctggatttatctcaaaacaatttatcttcagtcaccaatattaatgtaaaaaagatgcctcagctcctttctgtgtacctagaggaaaacaaacttactgaactgcctgaaaaatgtctgtccgaactgagcaacttacaagaactctatattaatcacaacttgctttctacaatttcacctggagcctttattggcctacataatcttcttcgacttcatctcaattcaaatagattgcagatgatcaacagtaagtggtttgatgctcttccaaatctagagattctgatgattggggaaaatccaattatcagaatcaaagacatgaactttaagcctcttatcaatcttcgcagcctggttatagctggtataaacctcacagaaataccagataacgccttggttggactggaaaacttagaaagcatctctttttacgataacaggcttattaaagtaccccatgttgctcttcaaaaagttgtaaatctcaaatttttggatctaaataaaaatcctattaatagaatacgaaggggtgattttagcaatatgctacacttaaaagagttggggataaataatatgcctgagctgatttccatcgatagtcttgctgtggataacctgccagatttaagaaaaatagaagctactaacaaccctagattgtcttacattcaccccaatgcatttttcagactccccaagctggaatcactcatgctgaacagcaatgctctcagtgccctgtaccatggtaccattgagtctctgccaaacctcaaggaaatcagcatacacagtaaccccatcaggtgtgactgtgtcatccgttggatgaacatgaacaaaaccaacattcgattcatggagccagattcactgttttgcgtggacccacctgaattccaaggtcagaatgttcggcaagtgcatttcagggacatgatggaaatttgtctccctcttatagctcctgagagctttccttctaatctaaatgtagaagctgggagctatgtttcctttcactgtagagctactgcagaaccacagcctgaaatctactggataacaccttctggtcaaaaactcttgcctaataccctgacagacaagttctatgtccattctgagggaacactagatataaatggcgtaactcccaaagaagggggtttatatacttgtatagcaactaacctagttggcgctgacttgaagtctgttatgatcaaagtggatggatcttttccacaagataacaatggctctttgaatattaaaataagagatattcaggccaattcagttttggtgtcctggaaagcaagttctaaaattctcaaatctagtgttaaatggacagcctttgtcaagactgaaaattctcatgctgcgcaaagtgctcgaataccatctgatgtcaaggtatataatcttactcatctgaatccatcaactgagtataaaatttgtattgatattcccaccatctatcagaaaaacagaaaaaaatgtgtaaatgtcaccaccaaaggtttgcaccctgatcaaaaagagtatgaaaagaataataccacaacacttatggcctgtcttggaggccttctggggattattggtgtgatatgtcttatcagctgcctctctccagaaatgaactgtgatggtggacacagctatgtgaggaattacttacagaaaccaacctttgcattaggtgagctttatcctcctctgataaatctctgggaagcaggaaaagaaaaaagtacatcactgaaagtaaaagcaactgttataggtttaccaacaaatatgtcctaaaaaccaccaaggaaacctactccaaaaatgaac

SEQ ID NO: 148231 - DNA, 3725 bp, Homo sapiens
  Payload ID: 9347
  Gene Symbol: LRRN3
  Gene Name: leucine rich repeat neuronal 3
  Uniprot ID: Q9H3W5
  ENST ID: ENST00000451085
  CDS Start-End: 1047-3173
tttcagccaaccagactggagcagctgcgagtgctacatcttggctgtctgaagcgattggctcctctctggggagtggagggtgttcagttattaatgaccgctgagcaggcagcaccatgtcagtgtgacaactgatcgggtgaacgatgcaccactaaccaccatggaaacaaggaaaaataaagccagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacctatttataccgggcaagaacacaaccatgtgattatctcaaccaaggaactgaggaatccagcacgcaaggacatcggaggtgggctagcactgaaactgcttttcaaggaggtgaagcattccacagataatcagctactctattcagggaaggagtgtaaacatcaccactttttgcatgtttgcataaaaaaggcccactgaatcagttaaagacgaggaagaggaggagaaagagaaagaagaggaagatgttgggcaacatttatttaacatgctccacagcccggaccctggcatcatgctgctattcctgcaaatactgaagaagcatgggatttaaatattttacttctaaataaatgaattactcaatctcctatgaccatctatacatactccaccttcaaaaagtacatcaatattatatcattaaggaaatagtaaccttctcttctccaatatgcatgacatttttggacaatgcaattgtggcactggcacttatttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatgaaggacatgccactccgaattcatgtgctacttggcctagctatcactacactagtacaagctgtagataaaaaagtggattgtccacggttatgtacgtgtgaaatcaggccttggtttacacccagatccatttatatggaagcatctacagtggattgtaatgatttaggtcttttaactttcccagccagattgccagctaacacacagattcttctcctacagactaacaatattgcaaaaattgaatactccacagactttccagtaaaccttactggcctggatttatctcaaaacaatttatcttcagtcaccaatattaatgtaaaaaagatgcctcagctcctttctgtgtacctagaggaaaacaaacttactgaactgcctgaaaaatgtctgtccgaactgagcaacttacaagaactctatattaatcacaacttgctttctacaatttcacctggagcctttattggcctacataatcttcttcgacttcatctcaattcaaatagattgcagatgatcaacagtaagtggtttgatgctcttccaaatctagagattctgatgattggggaaaatccaattatcagaatcaaagacatgaactttaagcctcttatcaatcttcgcagcctggttatagctggtataaacctcacagaaataccagataacgccttggttggactggaaaacttagaaagcatctctttttacgataacaggcttattaaagtaccccatgttgctcttcaaaaagttgtaaatctcaaatttttggatctaaataaaaatcctattaatagaatacgaaggggtgattttagcaatatgctacacttaaaagagttggggataaataatatgcctgagctgatttccatcgatagtcttgctgtggataacctgccagatttaagaaaaatagaagctactaacaaccctagattgtcttacattcaccccaatgcatttttcagactccccaagctggaatcactcatgctgaacagcaatgctctcagtgccctgtaccatggtaccattgagtctctgccaaacctcaaggaaatcagcatacacagtaaccccatcaggtgtgactgtgtcatccgttggatgaacatgaacaaaaccaacattcgattcatggagccagattcactgttttgcgtggacccacctgaattccaaggtcagaatgttcggcaagtgcatttcagggacatgatggaaatttgtctccctcttatagctcctgagagctttccttctaatctaaatgtagaagctgggagctatgtttcctttcactgtagagctactgcagaaccacagcctgaaatctactggataacaccttctggtcaaaaactcttgcctaataccctgacagacaagttctatgtccattctgagggaacactagatataaatggcgtaactcccaaagaagggggtttatatacttgtatagcaactaacctagttggcgctgacttgaagtctgttatgatcaaagtggatggatcttttccacaagataacaatggctctttgaatattaaaataagagatattcaggccaattcagttttggtgtcctggaaagcaagttctaaaattctcaaatctagtgttaaatggacagcctttgtcaagactgaaaattctcatgctgcgcaaagtgctcgaataccatctgatgtcaaggtatataatcttactcatctgaatccatcaactgagtataaaatttgtattgatattcccaccatctatcagaaaaacagaaaaaaatgtgtaaatgtcaccaccaaaggtttgcaccctgatcaaaaagagtatgaaaagaataataccacaacacttatggcctgtcttggaggccttctggggattattggtgtgatatgtcttatcagctgcctctctccagaaatgaactgtgatggtggacacagctatgtgaggaattacttacagaaaccaacctttgcattaggtgagctttatcctcctctgataaatctctgggaagcaggaaaagaaaaaagtacatcactgaaagtaaaagcaactgttataggtttaccaacaaatatgtcctaaaaaccaccaaggaaacctactccaaaaatgaacaaaaaaaaaaaaagcgaaagactgcagttgtgctaaaaacaaaacaaaacaaacaaacaaacaaaaaagtaaaaaaagattactttcgagagagaagtttaagcttcaccaatgctgctcctgaccaatggaaatatgtacaacttcagcattttaagtaactggcttcaaggggtactgtggcaaccaaataaaataactccattttctaaaactttcatgtaacttttatgtctggactacagttcaagtggacaaaaacatttctgtattttttttaagtaaataagagtagttgaactgagcaatacctcctcctgtgttgtattacacatattagccacgagtttttgcagtgaccagataaacttgaattgacacgtggtgtaataaaatggacaaattctgtagagtagacacagtgagtatgtggacctcttttataaggaaaaatacattttggattaaaatcaattgcttctgtcttgttttgtttctaaataaagaataatttctggg

SEQ ID NO: 148232 - DNA, 1830 bp, Homo sapiens
  Payload ID: 9347
  Gene Symbol: LRRN3
  Gene Name: leucine rich repeat neuronal 3
  ENST ID: ENST00000421101
  CDS Start-End: 1010-1830
atcttggctgtctgaagcgattggctcctctctggggagtggagggtgttcagttattaatgaccgctgagcaggcagcaccatgtcagtgtgacaactgatcgggtgaacgatgcaccactaaccaccatggaaacaaggaaaaataaagccagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacctatttataccgggcaagaacacaaccatgtgattatctcaaccaaggaactgaggaatccagcacgcaaggacatcggaggtgggctagcactgaaactgcttttcaaggaggtgaagcattccacagataatcagctactctattcagggaaggagtgtaaacatcaccactttttgcatgtttgcataaaaaaggcccactgaatcagttaaagacgaggaagaggaggagaaagagaaagaagaggaagatgttgggcaacatttatttaacatgctccacagcccggaccctggcatcatgctgctattcctgcaaatactgaagaagcatgggatttaaatattttacttctaaataaatgaattactcaatctcctatgaccatctatacatactccaccttcaaaaagtacatcaatattatatcattaaggaaatagtaaccttctcttctccaatatgcatgacatttttggacaatgcaattgtggcactggcacttatttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatgaaggacatgccactccgaattcatgtgctacttggcctagctatcactacactagtacaagctgtagataaaaaagtggattgtccacggttatgtacgtgtgaaatcaggccttggtttacacccagatccatttatatggaagcatctacagtggattgtaatgatttaggtcttttaactttcccagccagattgccagctaacacacagattcttctcctacagactaacaatattgcaaaaattgaatactccacagactttccagtaaaccttactggcctggatttatctcaaaacaatttatcttcagtcaccaatattaatgtaaaaaagatgcctcagctcctttctgtgtacctagaggaaaacaaacttactgaactgcctgaaaaatgtctgtccgaactgagcaacttacaagaactctatattaatcacaacttgctttctacaatttcacctggagcctttattggcctacataatcttcttcgacttcatctcaattcaaatagattgcagatgatcaacagtaagtggtttgatgctcttccaaatctagagattctgatgattggggaaaatccaattatcagaatcaaagacatgaactttaagcctcttatcaatcttcgcagcctggttatagctggtataaacctcacagaaataccagataacgccttggttggactggaaaacttagaaagcatctctttttacgataacaggcttattaaagtaccccatgttgctcttcaaaaagttgtaaatctcaaatttttggatctaaataaaaatcctattaatag

SEQ ID NO: 148233 - DNA, 3513 bp, Homo sapiens
  Payload ID: 9347
  Gene Symbol: LRRN3
  Gene Name: leucine rich repeat neuronal 3
  Uniprot ID: Q9H3W5
  ENST ID: ENST00000422987
  CDS Start-End: 832-2958
gcgagtgctacatcttggctgtctgaagcgattggctcctctctggggagtggagggtgttcagttattaatgaccgctgagcaggcagcaccatgtcagtgtgacaactgatcgggtgaacgatgcaccactaaccaccatggaaacaaggaaaaataaagccagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacctatttataccgggcaagaacacaaccatgtgattatctcaaccaaggaactgaggaatccagcacgcaaggacatcggaggtgggctagcactgaaactgcttttcaagcatcatgctgctattcctgcaaatactgaagaagcatgggatttaaatattttacttctaaataaatgaattactcaatctcctatgaccatctatacatactccaccttcaaaaagtacatcaatattatatcattaaggaaatagtaaccttctcttctccaatatgcatgacatttttggacaatgcaattgtggcactggcacttatttcagtgaagaaaaactttgtggttctatggcattcatcatttgacaaatgcaagcatcttccttatcaatcagctcctattgaacttactagcactgactgtggaatccttaagggcccattacatttctgaagaagaaagctaagatgaaggacatgccactccgaattcatgtgctacttggcctagctatcactacactagtacaagctgtagataaaaaagtggattgtccacggttatgtacgtgtgaaatcaggccttggtttacacccagatccatttatatggaagcatctacagtggattgtaatgatttaggtcttttaactttcccagccagattgccagctaacacacagattcttctcctacagactaacaatattgcaaaaattgaatactccacagactttccagtaaaccttactggcctggatttatctcaaaacaatttatcttcagtcaccaatattaatgtaaaaaagatgcctcagctcctttctgtgtacctagaggaaaacaaacttactgaactgcctgaaaaatgtctgtccgaactgagcaacttacaagaactctatattaatcacaacttgctttctacaatttcacctggagcctttattggcctacataatcttcttcgacttcatctcaattcaaatagattgcagatgatcaacagtaagtggtttgatgctcttccaaatctagagattctgatgattggggaaaatccaattatcagaatcaaagacatgaactttaagcctcttatcaatcttcgcagcctggttatagctggtataaacctcacagaaataccagataacgccttggttggactggaaaacttagaaagcatctctttttacgataacaggcttattaaagtaccccatgttgctcttcaaaaagttgtaaatctcaaatttttggatctaaataaaaatcctattaatagaatacgaaggggtgattttagcaatatgctacacttaaaagagttggggataaataatatgcctgagctgatttccatcgatagtcttgctgtggataacctgccagatttaagaaaaatagaagctactaacaaccctagattgtcttacattcaccccaatgcatttttcagactccccaagctggaatcactcatgctgaacagcaatgctctcagtgccctgtaccatggtaccattgagtctctgccaaacctcaaggaaatcagcatacacagtaaccccatcaggtgtgactgtgtcatccgttggatgaacatgaacaaaaccaacattcgattcatggagccagattcactgttttgcgtggacccacctgaattccaaggtcagaatgttcggcaagtgcatttcagggacatgatggaaatttgtctccctcttatagctcctgagagctttccttctaatctaaatgtagaagctgggagctatgtttcctttcactgtagagctactgcagaaccacagcctgaaatctactggataacaccttctggtcaaaaactcttgcctaataccctgacagacaagttctatgtccattctgagggaacactagatataaatggcgtaactcccaaagaagggggtttatatacttgtatagcaactaacctagttggcgctgacttgaagtctgttatgatcaaagtggatggatcttttccacaagataacaatggctctttgaatattaaaataagagatattcaggccaattcagttttggtgtcctggaaagcaagttctaaaattctcaaatctagtgttaaatggacagcctttgtcaagactgaaaattctcatgctgcgcaaagtgctcgaataccatctgatgtcaaggtatataatcttactcatctgaatccatcaactgagtataaaatttgtattgatattcccaccatctatcagaaaaacagaaaaaaatgtgtaaatgtcaccaccaaaggtttgcaccctgatcaaaaagagtatgaaaagaataataccacaacacttatggcctgtcttggaggccttctggggattattggtgtgatatgtcttatcagctgcctctctccagaaatgaactgtgatggtggacacagctatgtgaggaattacttacagaaaccaacctttgcattaggtgagctttatcctcctctgataaatctctgggaagcaggaaaagaaaaaagtacatcactgaaagtaaaagcaactgttataggtttaccaacaaatatgtcctaaaaaccaccaaggaaacctactccaaaaatgaacaaaaaaaaaaaaagcgaaagactgcagttgtgctaaaaacaaaacaaaacaaacaaacaaacaaaaaagtaaaaaaagattactttcgagagagaagtttaagcttcaccaatgctgctcctgaccaatggaaatatgtacaacttcagcattttaagtaactggcttcaaggggtactgtggcaaccaaataaaataactccattttctaaaactttcatgtaacttttatgtctggactacagttcaagtggacaaaaacatttctgtattttttttaagtaaataagagtagttgaactgagcaatacctcctcctgtgttgtattacacatattagccacgagtttttgcagtgaccagataaacttgaattgacacgtggtgtaataaaatggacaaattctgtagagtagacacagtgagtatgtggacctcttttataaggaaaaatacattttggattaaaatcaattgcttctgtcttgttttgtttctaaataaagaataatttctgggaaa

SEQ ID NO: 148234 - DNA, 2692 bp, Homo sapiens
  Payload ID: 9348
  Gene Symbol: LRRN4
  Gene Name: leucine rich repeat neuronal 4
  Uniprot ID: Q8WUT4
  ENST ID: ENST00000378858
  CDS Start-End: 226-2448
cgtcttgatgggaaaggaggagcaatgggaaagactggagtatctcagtccctctcagtggatgggggttgtgggagagaggcagctgggagacaggcctccctctggagttcatagctgagttgctgtccaaatcagtggtccctagaatctataaaacaaagctgagaacttcagaggtgcatccagagaagccacactccaaaaggaccacttccagacgccatgcggcaaaccctaccgctgctgctgctgacggtgctgcgccccagctgggcagaccctccccaggagaaggtcccgctcttccgggtcactcagcagggcccctgggggagcagtggcagcaacgccaccgactcgccctgcgaggggctgcccgccgcggatgcgacggccttgaccctggcgaaccgcaacctggagcgcctgcccggctgcctaccgcgcacactgcgcagcctcgacgccagccacaacctgctgcgcgccctgagcacttccgagctcggccacctggagcagctgcaggtgctgaccctgcgccacaaccgcatcgccgcgctgcgctggggcccgggtgggccggcggggctgcacaccctggacctcagctacaaccagctggccgctctgccgccgtgcaccgggcccgcgctgagcagcctccgcgccctggcgctcgccgggaatccgctgcgggcgctgcagccccgggccttcgcctgcttccccgcgctgcagctcctcaacctctcctgcaccgcgctgggtcgcggagcccaggggggcatcgccgaggcggcgttcgctggagaggatggcgcgcccctggtcacgctcgaagtcctggatctcagcggcacgttccttgaacgggttgagtcagggtggatcagagacctgccgaagctcacatccctctacctgaggaagatgcctcggctgacgaccctggagggggacattttcaagatgacccccaacctgcagcagctggactgtcaggactccccagcacttgcttctgtcgccacacacatctttcaagatactccacatctacaggtccttctgttccagaactgcaacttgagttccttccctccttggaccctggattcctcccaggtcctatcgatcaacctctttggcaaccccctcacttgcagttgtgacttgtcttggctcctcacggatgcaaagagaactgtcctaagcagggcagcagacactatgtgcgcgccagctgcgggatccagcggccccttctcagcctccctgtcactctcccagctgcccggagtgtgccagtccgaccaaagcaccactctcggggcttcacacccaccttgcttcaaccgctccacctacgcacagggtaccaccgtcgcgcccagcgcagcccccgccacccggcctgcgggagaccagcagagtgtctccaaggcccctaacgtgggctctcgcacgatagctgcatggccgcacagcgatgcacgggaggggactgccccctccacgaccaactctgtagcaggtcacagcaactccagcgttttccccagggctgccagcaccaccaggacccagcaccgaggagaacatgcccccgagcttgtccttgagcctgatatctcagctgcctccaccccactggccagcaagctcctgggccccttccctacctcgtgggaccgcagcataagctcgcctcagcccggccagaggacacacgccacaccccaagcccccaacccgagtctttccgagggcgagattccagtcttgctgctggacgactacagtgaggaggaggaagggaggaaggaggaggtgggaacgcctcaccaggacgtcccctgtgattaccatccctgcaagcacctgcagaccccgtgcgcggagctgcagaggcggtggcggtgccggtgccccggcctcagcggggaagacaccatcccagacccgcccaggctgcagggggtgacggagaccacggacacgtcggcgctggtccactggtgtgcccccaactcggtagtgcatgggtaccagatccgctactctgcggagggctgggcggggaaccagtcggtggtgggggtcatctacgccacggcccggcagcaccctctgtacgggctgtcgccgggcaccacctaccgcgtgtgcgtgctggcggccaacagggcgggcttgagccagccacggtcttcgggctggaggagcccgtgcgccgccttcaccaccaagcccagcttcgcgctcctgctctctgggctgtgcgccgccagcggcctgttgctcgccagcaccgtggtgctgtccgcatgtctctgcaggcggggccagacgctgggcctgcagcgctgcgacacgcacctggtggcctacaaaaacccggcctttgatgattacccgctggggctccagaccgtcagttagcccagcttctgggataacgcgtctcatcgaactggatctgagcgcaaaaaggaagacacagacggtcaaaaacgaccccatccgctcctagggtttctaattcccgtgaagccagaatgccttgagcacacatggaacttgccacactgagtgtctgggtccaaggaactgctgccctcccttccttctacttaactctgttcccagaaacctgatggtcaatgccagatcgctccccactgcc

SEQ ID NO: 148235 - DNA, 1745 bp, Homo sapiens
  Payload ID: 9349
  Gene Symbol: LRR1
  Gene Name: leucine rich repeat protein 1
  Uniprot ID: Q96L50
  ENST ID: ENST00000298288
  CDS Start-End: 325-1569
aaccaccgctgccagctgcgcgctcgggggaaaagacgttgcgcccccgccgactgccggtttcccgggcgcgagcccggatccaggtggtcagtcccggtacgcaaccacggcgagaacccggccctgctaagggagaagggaagccgtttcccgcgggcttcatacagacacggtgctaagacagcccgagtcgcggaccagtccaacaggcaggcagatcagtgggcagcccgcgtgcgcgaggaccccgatggcggcgccgggtggcgggaaggaggaagtttcaaagccagcttgacgtggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggccatttccagcagtttaaaaggtttcctttcagctatgagactggctcatagaggctgtaatgttgatacaccagtttcaacgctcacaccagtgaagacttcagaatttgaaaactttaaaactaaaatggttatcacatccaaaaaagactatcctctaagtaagaattttccatattccttggaacatcttcagacttcttactgtgggcttgtccgagttgatatgcgtatgctttgcttaaaaagccttaggaaattagacttgagtcacaaccatataaaaaagcttccagctacaattggagacctcatacaccttcaagaacttaacctgaatgacaatcacttggagtcatttagtgtagccttgtgtcattctacactccagaagtcacttcggagtttggacctcagcaagaacaaaatcaaggcactccctgtgcagttttgccagctccaggaacttaagaatttaaaacttgacgataatgaattgattcaatttccttgcaagataggacaactaataaaccttcgctttttgtcagcagctcgaaataagcttccatttttgcctagtgaatttagaaatttatcccttgaatacttggatctttttggaaatacttttgaacaaccaaaagtccttccagtaataaagctgcaagcaccattaactttattggaatcttctgcacgaaccatattacataataggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatacttgctggagaggaggaatgtgtatagttactcatttagatgactccaaaacttttattaaaaccaattttagtttta

SEQ ID NO: 148236 - DNA, 957 bp, Homo sapiens
  Payload ID: 9349
  Gene Symbol: LRR1
  Gene Name: leucine rich repeat protein 1
  Uniprot ID: Q96L50
  ENST ID: ENST00000318317
  CDS Start-End: 261-701
ccgggcgcgagcccggatccaggtggtcagtcccggtacgcaaccacggcgagaacccggccctgctaagggagaagggaagccgtttcccgcgggcttcatacagacacggtgctaagacagcccgagtcgcggaccagtccaacaggcaggcagatcagtgggcagcccgcgtgcgcgaggaccccgatggcggcgccgggtggcgggaaggaggaagtttcaaagccagcttgacgtggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaaggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatacttgctggagaggaggaatgtgtatagttactcatttagatgactccaaaacttttattaaaaccaattttagttt

SEQ ID NO: 148237 - DNA, 1597 bp, Homo sapiens
  Payload ID: 9349
  Gene Symbol: LRR1
  Gene Name: leucine rich repeat protein 1
  ENST ID: ENST00000540712
  CDS Start-End: 70-264
ggcggcgccgggtggcgggaaggaggaagtttcaaagccagcttgacgtggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagcactcaggatagaatagcaaaggagacaagattcctgctctcatggagtttgtatataacctactgggaggtgtgcccaccccaggctaatggactgaagttatgaagctaagggagaacattgagcaattcttcaccaaatttgtagatgaggggaaagccactgttcggttaaaggagcctcctgtggatatctgtctaagtaaggccatttccagcagtttaaaaggtttcctttcagctatgagactggctcatagaggctgtaatgttgatacaccagtttcaacgctcacaccagtgaagacttcagaatttgaaaactttaaaactaaaatggttatcacatccaaaaaagactatcctctaagtaagaattttccatattccttggaacatcttcagacttcttactgtgggcttgtccgagttgatatgcgtatgctttgcttaaaaagccttaggaaattagacttgagtcacaaccatataaaaaagcttccagctacaattggagacctcatacaccttcaagaacttaacctgaatgacaatcacttggagtcatttagtgtagccttgtgtcattctacactccagaagtcacttcggagtttggacctcagcaagaacaaaatcaaggcactccctgtgcagttttgccagctccaggaacttaagaatttaaaacttgacgataatgaattgattcaatttccttgcaagataggacaactaataaaccttcgctttttgtcagcagctcgaaataagcttccatttttgcctagtgaatttagaaatttatcccttgaatacttggatctttttggaaatacttttgaacaaccaaaagtccttccagtaataaagctgcaagcaccattaactttattggaatcttctgcacgaaccatattacataataggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatacttgctggagaggaggaatgtgtatagttactcatttagatgactccaaaacttttattaaaaccaattttagtttt

SEQ ID NO: 148238 - DNA, 1886 bp, Homo sapiens
  Payload ID: 9349
  Gene Symbol: LRR1
  Gene Name: leucine rich repeat protein 1
  ENST ID: ENST00000554869
  CDS Start-End: 247-648
ggatccaggtggtcagtcccggtacgcaaccacggcgagaacccggccctgctaagggagaagggaagccgtttcccgcgggcttcatacagacacggtgctaagacagcccgagtcgcggaccagtccaacaggcaggcagatcagtgggcagcccgcgtgcgcgaggaccccgatggcggcgccgggtggcgggaaggaggaagtttcaaagccagcttgacgtggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgagctaagggagaacattgagcaattcttcaccaaatttgtagatgaggggaaagccactgttcggttaaaggagcctcctgtggatatctgtctaagtaagatggagtctcattctgtcacccaggttggagtgcagtgggaagagcttggttcactgcaacccacaggccatttccagcagtttaaaaggtttcctttcagctatgagactggctcatagaggctgtaatgttgatacaccagtttcaacgctcacaccagtgaagacttcagaatttgaaaactttaaaactaaaatggttatcacatccaaaaaagactatcctctaagtaagaattttccatattccttggaacatcttcagacttcttactgtgggcttgtccgagttgatatgcgtatgctttgcttaaaaagccttaggaaattagacttgagtcacaaccatataaaaaagcttccagctacaattggagacctcatacaccttcaagaacttaacctgaatgacaatcacttggagtcatttagtgtagccttgtgtcattctacactccagaagtcacttcggagtttggacctcagcaagaacaaaatcaaggcactccctgtgcagttttgccagctccaggaacttaagaatttaaaacttgacgataatgaattgattcaatttccttgcaagataggacaactaataaaccttcgctttttgtcagcagctcgaaataagcttccatttttgcctagtgaatttagaaatttatcccttgaatacttggatctttttggaaatacttttgaacaaccaaaagtccttccagtaataaagctgcaagcaccattaactttattggaatcttctgcacgaaccatattacataatagaaccatctatccgaaagagattaatgtaaacatgtgggagacactccctggcagagttttttaaaaaatggttacttaagcaacagattaataagtctttttatgaaaaatttaaaaattgcaaatagggccatcctagatcccgtaccaaaggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatacttgctggagaggaggaatgtgtatagttactcatttagatgactccaaaacttttattaaaaccaattttagtttt

SEQ ID NO: 148239 - DNA, 2599 bp, Homo sapiens
  Payload ID: 9350
  Gene Symbol: LRRTM1
  Gene Name: leucine rich repeat transmembrane neuronal 1
  Uniprot ID: Q86UE6
  ENST ID: ENST00000295057
  CDS Start-End: 658-2226
actcagtgagcagtaggtgcctgtgcaagctcgcgccgcacactgcctggtggagggaaggagcccgggcgccgctcgccgctccccgcgccgccgtccgcacctccccaccgcccgccgcccgccgcccgccgcccgcaaagcatgagtgagcccgctctctgcagctgcccggggcgcgaatggcaggctgtttccgcggagtaaaaggtggcgccggtcagtggtcgtttccaatgacggacattaaccagactgtcagatcctggggagtcgcgagccccgagtttggagttttttccccccacaacgtcacagtccgaactgcagagggaaaggaaggcggcaggaaggcgaagctcgggctccggcacgtagttgggaaacttgcgggtcctagaagtcgcctccccgccttgccggccgcccttgcagccccgagccgagcagcaaagtgagacattgtgcgcctgccagatccgccggccgcggaccggggctgcctcggaaacacagaggggtcttctctcgccctgcatataattagcctgcacacaaagggagcagctgaatggaggttgtcactctctggaaaaggatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaaggtgaacttcgcccacttcccgcgcctcatctccctgcactcgctctgcctgcggaggaacaaggtggccattgtggtcagctcgctggactgggtttggaacctggagaaaatggacttgtcgggcaacgagatcgagtacatggagccccatgtgttcgagaccgtgccgcacctgcagtccctgcagctggactccaaccgcctcacctacatcgagccccggatcctcaactcttggaagtccctgacaagcatcaccctggccgggaacctgtgggattgcgggcgcaacgtgtgtgccctagcctcgtggctcaacaacttccaggggcgctacgatggcaacttgcagtgcgccagcccggagtacgcacagggcgaggacgtcctggacgccgtgtacgccttccacctgtgcgaggatggggccgagcccaccagcggccacctgctctcggccgtcaccaaccgcagtgatctggggccccctgccagctcggccaccacgctcgcggacggcggggaggggcagcacgacggcacattcgagcctgccaccgtggctcttccaggcggcgagcacgccgagaacgccgtgcagatccacaaggtggtcacgggcaccatggccctcatcttctccttcctcatcgtggtcctggtgctctacgtgtcctggaagtgtttcccagccagcctcaggcagctcagacagtgctttgtcacgcagcgcaggaagcaaaagcagaaacagaccatgcatcagatggctgccatgtctgcccaggaatactacgttgattacaaaccgaaccacattgagggagccctggtgatcatcaacgagtatggctcgtgtacctgccaccagcagcccgcgagggaatgcgaggtgtgattgtcccagtggctctcaacccatgcgctaccaaatacgcctgggcagccgggacgggccggcgggcaccaggctggggtctccttgtctgtgctctgatatgctccttgactgaaactttaaggggatctctcccagagacttgacattttagctttattgtgtcttaaaaacaaaagcgaattaaaacacaacaaaaaaccccaccccacaaccttcaggacagtctatcttaaatttcatatgagaactccttcctccctttgaagatctgtccatattcaggaatctgagagtgtaaaaaaggtaccaatcattgattttttttttttttgtaaactaaaatgtttaaaataaaatagcatttacagtt

SEQ ID NO: 148240 - DNA, 2126 bp, Homo sapiens
  Payload ID: 9350
  Gene Symbol: LRRTM1
  Gene Name: leucine rich repeat transmembrane neuronal 1
  Uniprot ID: Q86UE6
  ENST ID: ENST00000409148
  CDS Start-End: 187-1755
agatccgccggccgcggaccggggctgcctcggaaacacagaggggtcttctctcgccctgcatataattagcctgcacacaaagggagcagctgaatggaggttgtcactctctggaaaagggtggatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaaggtgaacttcgcccacttcccgcgcctcatctccctgcactcgctctgcctgcggaggaacaaggtggccattgtggtcagctcgctggactgggtttggaacctggagaaaatggacttgtcgggcaacgagatcgagtacatggagccccatgtgttcgagaccgtgccgcacctgcagtccctgcagctggactccaaccgcctcacctacatcgagccccggatcctcaactcttggaagtccctgacaagcatcaccctggccgggaacctgtgggattgcgggcgcaacgtgtgtgccctagcctcgtggctcaacaacttccaggggcgctacgatggcaacttgcagtgcgccagcccggagtacgcacagggcgaggacgtcctggacgccgtgtacgccttccacctgtgcgaggatggggccgagcccaccagcggccacctgctctcggccgtcaccaaccgcagtgatctggggccccctgccagctcggccaccacgctcgcggacggcggggaggggcagcacgacggcacattcgagcctgccaccgtggctcttccaggcggcgagcacgccgagaacgccgtgcagatccacaaggtggtcacgggcaccatggccctcatcttctccttcctcatcgtggtcctggtgctctacgtgtcctggaagtgtttcccagccagcctcaggcagctcagacagtgctttgtcacgcagcgcaggaagcaaaagcagaaacagaccatgcatcagatggctgccatgtctgcccaggaatactacgttgattacaaaccgaaccacattgagggagccctggtgatcatcaacgagtatggctcgtgtacctgccaccagcagcccgcgagggaatgcgaggtgtgattgtcccagtggctctcaacccatgcgctaccaaatacgcctgggcagccgggacgggccggcgggcaccaggctggggtctccttgtctgtgctctgatatgctccttgactgaaactttaaggggatctctcccagagacttgacattttagctttattgtgtcttaaaaacaaaagcgaattaaaacacaacaaaaaaccccaccccacaaccttcaggacagtctatcttaaatttcatatgagaactccttcctccctttgaagatctgtccatattcaggaatctgagagtgtaaaaaaggtaccaatcattgattttttttttttttgtaaactaaaatgtttaaaataaaatagcatttacag

SEQ ID NO: 148241 - DNA, 765 bp, Homo sapiens
  Payload ID: 9350
  Gene Symbol: LRRTM1
  Gene Name: leucine rich repeat transmembrane neuronal 1
  ENST ID: ENST00000452811
  CDS Start-End: 215-765
acgtcacagtccgaactgcagagggaaaggaaggcggcaggaaggcgaagctcgggctccggcacgtagttgggaaacttgcgggtcctagaagtcgcctccccgccttgccggccgcccttgcagccccgagccgagcagcaaagtgagacattatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactg

SEQ ID NO: 148242 - DNA, 3021 bp, Homo sapiens
  Payload ID: 9350
  Gene Symbol: LRRTM1
  Gene Name: leucine rich repeat transmembrane neuronal 1
  Uniprot ID: Q86UE6
  ENST ID: ENST00000417012
  CDS Start-End: 302-1870
aagctcgggctccggcacgtagttgggaaacttgcgggtcctagaagtcgcctccccgccttgccggccgcccttgcagccccgagccgagcagcaaagtgagacattgtgcgcctgccagatccgccggccgcggaccggggctgcctcggaaacacagaggggtcttctctcgccctgcatataattagcctgcacacaaagggagcagctgaatggaggttgtcactctctggaaaaggatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaaggtgaacttcgcccacttcccgcgcctcatctccctgcactcgctctgcctgcggaggaacaaggtggccattgtggtcagctcgctggactgggtttggaacctggagaaaatggacttgtcgggcaacgagatcgagtacatggagccccatgtgttcgagaccgtgccgcacctgcagtccctgcagctggactccaaccgcctcacctacatcgagccccggatcctcaactcttggaagtccctgacaagcatcaccctggccgggaacctgtgggattgcgggcgcaacgtgtgtgccctagcctcgtggctcaacaacttccaggggcgctacgatggcaacttgcagtgcgccagcccggagtacgcacagggcgaggacgtcctggacgccgtgtacgccttccacctgtgcgaggatggggccgagcccaccagcggccacctgctctcggccgtcaccaaccgcagtgatctggggccccctgccagctcggccaccacgctcgcggacggcggggaggggcagcacgacggcacattcgagcctgccaccgtggctcttccaggcggcgagcacgccgagaacgccgtgcagatccacaaggtggtcacgggcaccatggccctcatcttctccttcctcatcgtggtcctggtgctctacgtgtcctggaagtgtttcccagccagcctcaggcagctcagacagtgctttgtcacgcagcgcaggaagcaaaagcagaaacagaccatgcatcagatggctgccatgtctgcccaggaatactacgttgattacaaaccgaaccacattgagggagccctggtgatcatcaacgagtatggctcgtgtacctgccaccagcagcccgcgagggaatgcgaggtgtgattgtcccagtggctctcaacccatgcgctaccaaatacgcctgggcagccgggacgggccggcgggcaccaggctggggtctccttgtctgtgctctgatatgctccttgactgaaactttaaggggatctctcccagagacttgacattttagctttattgtgtcttaaaaacaaaagcgaattaaaacacaacaaaaaaccccaccccacaaccttcaggacagtctatcttaaatttcatatgagaactccttcctccctttgaagatctgtccatattcaggaatctgagagtgtaaaaaagttctgtcaacagattcagtccccagtcctccttctctgagcagacctctcatccgcagcatatatctgctagatcttctaagagctgaaatggagacttctggaagaaggtgggaaagaaatccatctcggcttaattaaccatttatcgcatcatattactcccatcttaaaagtgcacgcgttgtttttctgaaccctcacacaaaggctactactgtggtcccatatctgtcggcccatgagaaacagtgttcttggacctcacagccaagcagcactgaactgcagcaaaatccagcaacacattcagcagcgagcagcctgctgagctccactggtttatccggggccaccaaccccaaagaactgggatgaaagcagatgtgagagaggaaaaggatctgtttttgttttattttctaccaggcccagctctttgtggggggaataaaaaagaagaaaaatcgagctccaagctggtgccctgccaagcttcctcccctcccttcctagtccaagcactccaccgtctgtgcagactgcataacagcaatttctggaaacaggctgaagaatctgggccagtccagaggcagtggattcctggtttatgtgtggtggggtttttaggaattttatttttcaccttaattctttcaacaactgccagctgtttgaagcacatctgtaataaacagcttctgtttgtaaaatgagactgaagttatcctctccagagaaattcctgaatcttctctgtagttcaatgccttcactgacagtttggctcaaaaagtatgagtgtggtaaatattaaagaatgttaatacaagtgtaatgaaa

SEQ ID NO: 148243 - DNA, 578 bp, Homo sapiens
  Payload ID: 9350
  Gene Symbol: LRRTM1
  Gene Name: leucine rich repeat transmembrane neuronal 1
  ENST ID: ENST00000415098
  CDS Start-End: 252-578
cttgcagccccgagccgagcagcaaagtgagacattgtgcgcctgccagatccgccggccgcggaccggggctgcctcggaaacacagaggggtcttctctcgccctgcatataattagcctgcacacaaagggagcagctgaatggaggttgtcactctctggaaaagggtggctttctgcatgcttagagatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgccttt

SEQ ID NO: 148244 - DNA, 4023 bp, Homo sapiens
  Payload ID: 9350
  Gene Symbol: LRRTM1
  Gene Name: leucine rich repeat transmembrane neuronal 1
  Uniprot ID: Q86UE6
  ENST ID: ENST00000433224
  CDS Start-End: 639-2207
cctgtgcaagctcgcgccgcacactgcctggtggagggaaggagcccgggcgccgctcgccgctccccgcgccgccgtccgcacctccccaccgcccgccgcccgccgcccgccgcccgcaaagcatgagtgagcccgctctctgcagctgcccggggcgcgaatggcaggctgtttccgcggagtaaaaggtggcgccggtcagtggtcgtttccaatgacggacattaaccagactgtcagatcctggggagtcgcgagccccgagtttggagttttttccccccacaacgtcacagtccgaactgcagagggaaaggaaggcggcaggaaggcgaagctcgggctccggcacgtagttgggaaacttgcgggtcctagaagtcgcctccccgccttgccggccgcccttgcagccccgagccgagcagcaaagtgagacattgtgcgcctgccagatccgccggccgcggaccggggctgcctcggaaacacagaggggtcttctctcgccctgcatataattagcctgcacacaaagggagcagctgaatggaggttgtcactctctggaaaaggatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaaggtgaacttcgcccacttcccgcgcctcatctccctgcactcgctctgcctgcggaggaacaaggtggccattgtggtcagctcgctggactgggtttggaacctggagaaaatggacttgtcgggcaacgagatcgagtacatggagccccatgtgttcgagaccgtgccgcacctgcagtccctgcagctggactccaaccgcctcacctacatcgagccccggatcctcaactcttggaagtccctgacaagcatcaccctggccgggaacctgtgggattgcgggcgcaacgtgtgtgccctagcctcgtggctcaacaacttccaggggcgctacgatggcaacttgcagtgcgccagcccggagtacgcacagggcgaggacgtcctggacgccgtgtacgccttccacctgtgcgaggatggggccgagcccaccagcggccacctgctctcggccgtcaccaaccgcagtgatctggggccccctgccagctcggccaccacgctcgcggacggcggggaggggcagcacgacggcacattcgagcctgccaccgtggctcttccaggcggcgagcacgccgagaacgccgtgcagatccacaaggtggtcacgggcaccatggccctcatcttctccttcctcatcgtggtcctggtgctctacgtgtcctggaagtgtttcccagccagcctcaggcagctcagacagtgctttgtcacgcagcgcaggaagcaaaagcagaaacagaccatgcatcagatggctgccatgtctgcccaggaatactacgttgattacaaaccgaaccacattgagggagccctggtgatcatcaacgagtatggctcgtgtacctgccaccagcagcccgcgagggaatgcgaggtgtgattgtcccagtggctctcaacccatgcgctaccaaatacgcctgggcagccgggacgggccggcgggcaccaggctggggtctccttgtctgtgctctgatatgctccttgactgaaactttaaggggatctctcccagagacttgacattttagctttattgtgtcttaaaaacaaaagcgaattaaaacacaacaaaaaaccccaccccacaaccttcaggacagtctatcttaaatttcatatgagaactccttcctccctttgaagatctgtccatattcaggaatctgagagtgtaaaaaaggtggccataagacagagagagaataatcgtgctttgttttatgctactcctcccaccctgcccatgattaaacatcatgtatgtagaagatcttaagtccatacgcatttcatgaagaaccattggaaagaggaatctgcaatctgggagcttaagagcaaatgatgaccatagaaagctatgttcttactttgtgtgtgtgtctgtatgtttctgcgttgtgtgtctttgtaggcaagcaaacgttgtctacacaaacgggaatttagctcacatcatttcatgcccctgtgcctctagctctggagattggtggggggaggtggggggaaacggcaggaataagggaaagtggtagttttaactaaggttttgtaacacttgaaatcttttctttctcaaattaattaatctttaagcttcaagaaacttgctctgacccctctaagcaaactactaagcatttaaaagagaatctaatttttaaaggtgtagcaccttttttttattcttcccacagagggtgctaatctcattatgctgtgctatctgaaaagaacttaaggccacaattcacgtctcgtcctgggcattgtgatggattgaccctccatttgcagtaccttcccagctgattaaagttcagcagtggtattgaggtttttcgaatatttatatagaaaaaaagtcttttcacatgacaaatgacactctcacaccagtcttagccctagtagttttttaggttggaccagaggaagcaggttaaatgagacctgtcctctgctgcactcagaaaaaataggcagtccctgatgctcagatcttagccttgatattaatagttgagaccacctacccacaatgcagcctatactcccaagactacaaagttaccatcgcaaaggaaaggttattccagtaaaaggaaatagttttctcaaccatttaaaaatattcttctgaactcatcaaagtagaagagcccccaaccttttctctctgccttcaagaaggcagacatttggtatgatttagcatcaacaacacatttatgagtatatgtaagtaatcagaggggcaaatgccacttgttattcctcccaagttttccaagcaagtacacacagatctctggtaggattaggggccacttgtgtttccggcttattttagtcgacttgtcagcaagtttgatgcctagtctatctgacatggcccagtagaacagggcattgatggatcacatgagatggtagaaggaacatcatcacatacccctctcacagagaaaattatcaaagaaccagaaattatatctgttttggagcaagagtgtcataatgtttcagggtagtcaaaataaacataaattatctcctctagatgagtggcgatgttggctgatttgggtctgccattgacagaatgtcaaataaaaaggaattagctagaatatgaccattaaatgtgcttctgaaatatattttgagataggtttagaatgtca

SEQ ID NO: 148245 - DNA, 879 bp, Homo sapiens
  Payload ID: 9350
  Gene Symbol: LRRTM1
  Gene Name: leucine rich repeat transmembrane neuronal 1
  ENST ID: ENST00000416268
  CDS Start-End: 211-879
ccgctctctgcagctgcccggggcgcgaatggcaggctgtttccgcggagtaaaaggtggcgccgcatctaacatggaccaaatcaccatctctttgatctttccgtggctgtgaactttctatgctgcccagctttctgcatgcttagagatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaag

SEQ ID NO: 148246 - DNA, 6017 bp, Homo sapiens
  Payload ID: 9351
  Gene Symbol: LRRTM2
  Gene Name: leucine rich repeat transmembrane neuronal 2
  Uniprot ID: O43300
  ENST ID: ENST00000274711
  CDS Start-End: 380-1930
tgctgctccaggagctcttctctgcaacaagccacccatctgccatcaacaagttaagaccaagagaactaacggctgcggaaaggagactgaagctttgattaaccagctgagcagttagaggtggagaaatttaataacttatattcaaaactgatttagggatcagagcaatcacagaaaatgaaaccaatgctttccagagggatatcctaaggaaaaaacaactcgtcctggtggattcaattttacttggaaagcctgggacacagaaaacaggaaactggtcaaaggctcctacatgttagagccttttacagactcactgcgttgagtctaacaaccgcgactgaatgcagcctccaatgtgctcagaagaatgggcttacatttcaagtggccattaggggcccctatgctggcagcaatatatgcaatgagtatggttttaaaaatgctgcctgccctgggtatggcgtgtccacccaaatgccgctgcgagaagctgctcttctactgcgactctcagggcttccactcagtgccaaacgccacagacaagggctctctgggcctgtccctgaggcacaatcacatcacagagctcgaaagagatcaatttgccagcttcagtcaacttacttggctccacttagatcacaatcaaatttcaacagtaaaagaagatgcttttcaaggactatataaacttaaggaattaatcttaagttccaacaaaatattttacttgccaaacacaacttttacccaactgattaacctgcaaaatttggacctgtcttttaatcagctgtcatctctgcacccagagctcttctatggccttcggaagctgcagaccttgcatttacgttccaactccctgcggactatcccagtacgcctgttctgggactgtcgtagtctggagtttctggatttgagcacaaatcgtttgcgaagtttggctcgcaatggatttgcaggattaattaaactgagagagcttcacctagagcacaaccagctgacgaagattaattttgctcatttcctacggctaagcagtctgcacacgctcttcttacaatggaacaaaatcagcaacttgacatgtgggatggagtggacctggggcactttagaaaagctagacctgactggaaatgaaatcaaagccatcgacttgacagtgtttgaaacgatgcccaatcttaaaatactcctcatggataacaacaagttaaacagccttgattccaagatcttaaactccctgagatccctcacaaccgttggtctctctggcaatctgtgggaatgcagcgcccgaatatgtgctctggcctcctggctgggcagtttccaaggtcggtgggaacactccatcctatgccacagtcctgaccacacccaaggagaggatattctagatgcagtccatggatttcagctctgctggaatttgtcaaccactgtcactgtcatggctacaacttatagagatccaaccactgaatatacaaaaagaataagctcatcaagttaccatgtgggagacaaagaaatcccaactactgcaggcatagcagttactaccgaggaacactttcctgaaccagacaatgccatcttcactcagcgggtaattacgggaacaatggctttattgttttctttcttttttattatttttatagtgttcatctccaggaagtgctgccctcccactttaagaagaattaggcagtgctcaatggttcagaaccacaggcagctccgatcccaaacacgactccatatgtcaaacatgtcagaccaaggaccgtataatgaatatgaacccacccatgaaggacccttcatcatcattaatggttatggacagtgcaagtgtcagcagctgccatacaaagaatgtgaagtataatatctacccatcatcaaaaatcacatcagataagtaacctattttacatagtagaggctaaatacatatctaatttttaccaatggtgacattaagcctaattttccaaactaagtggagacttagtttttgaagtgttgaagtatttttaattttttaaatgaaaccatattttaagtgttaaatgaatcaatgctcacattaatttgcactcctgttggaaagtctaaaatgcttacttcaaaataagaaatgtatgtaattatatacaatcgtgtgtaaacctttacactaaggtctccatatactatttttttctactgaaaacaatttagaaagaagctattgggcagaaacagatatagatcaatacctgtttgatcactgctctccatcccatgtaccacaactatcttgctgcttaaaaggagacttagtaaagttctcttgtatgataatttggtatttactcaaatcttcaatttcttgccagggtgggaagtagaatttcatgtatgctgaagactggtaaatattaaacattctccttccagagtttctgcctgggttagtagatattatcaaagtccatatcatgaattcagaaccctttaatgtaattctaataagctgagtgactctttaatatatttacacaatgaatccaagtgactgtgaaaaggtctcattacaatgaaaccaatcctaaataattacaccaacttcttatacatttctcgtttgacttataatggacatgatttttgtggcatttagacaactgttttaaactagcattaaactgtcattgtactaattaatgtactaaatcctatgtttacattaatatgtgaaaaaagatttagaagatattttggagataaacaagacaaactgagtcaatttaacaatcctgacatgctccctccaatttaaaagcgcacacacacacacacacacacacacacacacacacacacactctcgcgctctctctctcaactatcatgatcaaagatgccttgacaaaggggtttaaacctctttcttctgctttttcctgatcttcaaacctcaaagagccaagttaaaaataattggctagcaacaggcttaacactgattcttattgtattacaaaggaaccatgaaaaaaaacactttccaactattatataatacatttcgatctttcaataaagatacgcattcacgctgtaagtgtagttcagtgtaggtgaagaaaacagcaccactgagatgaatctcatggcagaacaactcgacatgcctatgcagccacacagtggtaacttgaaggcagcacagaggtgagggattaaaaggaaaggcagattttgaaatctgactctcaggttagctggagttacaaggcagccaacaatgattatacacaatctgcaccaaacagggaaaggacctgctgctgaaaagggaagaggggtagatcctccaatgtaaatataaacatgccatagttaacaaatgataaggatgccacatttttcatgcagaaaagaaccacaggtattcagtttcttgtattatgatttctaaagaaaacctattaaatatttggaatttagatgcaagctactcattcacacagaacttttccataaacattgttccacatattgaaaaaactgtaaaattatagcactaacttgattttagaaaatgagcattttttacaactgccatttactgtatgtagaaaaaagacataaaaccttagagaaagccactaccatttttcaagttatcttttccccaacatcaacatcaacatgatatccttcattcagggcatattttttcttcccaggatcaaactgaaaacatgttaaggctatagtttagccagtaagatttaatcacaatttttcttctttaatactaagagatgggtaccttagtacccttcacctaacatctctcggtaaaaagcagacaagatcacaaattacagtaaaaatgtgctcttttttaaggtgggcagattagtttgtcaaagtctcagcccagttcaattcagttgatctcgagtggtgagtattttgtctcttgttaaaccagaccctgggcttgtctgggcagagacagaagctgatttaacagcatagagcacagcgccctacttccccacagacaggctgaattagaagcccctattacaaataagagcaccacgagctaaaatttaccaacccatttatcaggatgaccattgccatttgtcaggtgacagacagcttggtcacaacacaactgtgtcctgagcacacaagattccatcagccctgaaggacagcagaggagtattttccatcatttcaaaccacaaacaaaattaagatttaaactgtgggatgggtaagaaatccccttctttggctgggaatctccaccttaatccttaaaggaccataactggcaaaatccttagtgtacggacaaaagcaaattggaaaagccagccatttactaattcagaggaacagcatagccaaggctagcgaggcatactttccagttgaaaaaaatcaaaattttttgccttccatttttctgggtaatgtcctttaagaaaagtgaatgacagtagtaccaaaaaggtattttcctttctcatttaaaagcaaaaacctccctttttaattgcctgtagaaggcaagattttctttcatttttgtccatttgtgtttcagaatcagcacaggtttgaagattagactgttagtcatctgtgctttctttaccaactggctagaacggaacagcatcacagcaacgctgcggatcttggttacacagtgtcagagcttttgttttttgatggggttttatcctcttcaccaccactacccactccattttttttctatttttaagattagaggaaaatgaccattaagaaccagaaaaataattaatctctctggaaaaaggaaagctaaagaagactatgataccatacccatctagaaaccaagaactagtttgaaatcgtttatattcatttctgtagcatgacagggatttcaatcacctttctgaaaagagtgggctgataaacttgtaaatccacacacaactctgagaatacccactgccagcatcaaaaagcaaagatactaattttttaagccaaaaatctgtactaacacatgtaatttcttaatgtgcctaagttaatttctgtatcaattcaataaatggaattgactgaacttcccaacgccactaattattaaaatccatctgcttattctaatgctagtcaccaagagctagactccatctttccaataaaaatgagccctatgtagcactaggtttgaattctaaaattcaaaacaggcatttcattttcttaaggcacacttcctacacacagctatcaggggaaaaagctataaatgtcctgttctttttctgaagtgtggatatcaatataaaatttgttaaagaatatttttaacagctgacttacatgatcgttttcctaatacaggaatacagcgacagacctatctgaaaagtctgtttgggggcatacttttcatatcttattgactaaagcccttgagccaggaaaaaaaaaaaaaaagagagagagacagtaaggccatctatagataattaaatatttctctatctaacctggggcaaactcatagtacttgaataaggccaaaaacaaatagaaaattactgtttaagctttcattctgctattgcaaacatttggaaacctctgcaactctttcaactaacatttttgtccttagcggtttttttttttttttttaagtctgatatatggaatgtttggtgaaccttcctatcaacactgagactggaaactcaaagtacagtccaaatacattgtgttcaatcaccttcaagagccatttttctttttgggtgggaggtgggcagatgggttgagggtgggaagaaaatactattatgcagggtgttttgggaggggggagggtaacataaagagcagtgtacaggcaagttttgttattaaaattgtgtatactgtaaaaagtg

SEQ ID NO: 148247 - DNA, 1958 bp, Homo sapiens
  Payload ID: 9351
  Gene Symbol: LRRTM2
  Gene Name: leucine rich repeat transmembrane neuronal 2
  ENST ID: ENST00000518785
  CDS Start-End: 458-574
agttctgtgtggtcgcagcacataagcaaatccattcttgtgccgtttctcggaaaagcttttcagtaaatgcactcatgctgctccaggagctcttctctgcaacaagccacccatctgccatcaacaagttaagaccaagagaactaacggctgcggaaaggagactgaagctttgattaaccagctgagcagttagaggtggagaaatttaataacttatattcaaaactgatttagggatcagagcaatcacagaaaatgaaaccaatgctttccagagggatatcctaaggaaaaaacaactcgtcctggtggattcaattttacttggaaagcctgggacacagaaaacaggaaactggtcaaaggctcctacatgttagagccttttacagactcactgcgttgagtctaacaaccgcgactgaatgcagcctccaatgtgctcagaagaatggctgtcatctctgcacccagagctcttctatggccttcggaagctgcagaccttgcatttacgttccaactccctgcggactatcccagtacgcctgttctgggactgtcgtagtctggagtttctggatttgagcacaaatcgtttgcgaagtttggctcgcaatggatttgcaggattaattaaactgagagagcttcacctagagcacaaccagctgacgaagattaattttgctcatttcctacggctaagcagtctgcacacgctcttcttacaatggaacaaaatcagcaacttgacatgtgggatggagtggacctggggcactttagaaaagctagacctgactggaaatgaaatcaaagccatcgacttgacagtgtttgaaacgatgcccaatcttaaaatactcctcatggataacaacaagttaaacagccttgattccaagatcttaaactccctgagatccctcacaaccgttggtctctctggcaatctgtgggaatgcagcgcccgaatatgtgctctggcctcctggctgggcagtttccaaggtcggtgggaacactccatcctatgccacagtcctgaccacacccaaggagaggatattctagatgcagtccatggatttcagctctgctggaatttgtcaaccactgtcactgtcatggctacaacttatagagatccaaccactgaatatacaaaaagaataagctcatcaagttaccatgtgggagacaaagaaatcccaactactgcaggcatagcagttactaccgaggaacactttcctgaaccagacaatgccatcttcactcagcgggtaattacgggaacaatggctttattgttttctttcttttttattatttttatagtgttcatctccaggaagtgctgccctcccactttaagaagaattaggcagtgctcaatggttcagaaccacaggcagctccgatcccaaacacgactccatatgtcaaacatgtcagaccaaggaccgtataatgaatatgaacccacccatgaaggacccttcatcatcattaatggttatggacagtgcaagtgtcagcagctgccatacaaagaatgtgaagtataatatctacccatcatcaaaaatcacatcagataagtaacctattttacatagtagaggctaaatacatatctaatttttaccaatggtgacattaagcctaattttccaaactaagtggagacttagtttttgaagtgttgaagtatttttaattttttaaatgaaaccatattttaagtgttaaatgaatcaatgctcacattaatttgcactcctgttggaaagtctaaaatgcttacttcaaaataagaaatgtatgtaattatatacaatcgtgtgtaaacctttacactaaggtctccatatactatttttttctactgaaaacaatttagaaagaagctattgggcagaaacagatatagatcaatacctgtt

SEQ ID NO: 148248 - DNA, 1182 bp, Homo sapiens
  Payload ID: 9351
  Gene Symbol: LRRTM2
  Gene Name: leucine rich repeat transmembrane neuronal 2
  ENST ID: ENST00000521094
  CDS Start-End: 394-627
agtaaatgcactcatgctgctccaggagctcttctctgcaacaagccacccatctgccatcaacaagttaagaccaagagaactaacggctgcggaaaggagactgaagctttgattaaccagctgagcagttagaggtggagaaatttaataacttatattcaaaactgatttagggatcagagcaatcacagaaaatgaaaccaatgctttccagagggatatcctaaggaaaaaacaactcgtcctggtggattcaattttacttggaaagcctgggacacagaaaacaggaaactggtcaaaggctcctacatgttagagccttttacagactcactgcgttgagtctaacaaccgcgactgaatgcagcctccaatgtgctcagaagaatggtgttcatctccaggaagtgctgccctcccactttaagaagaattaggcagtgctcaatggttcagaaccacaggcagctccgatcccaaacacgactccatatgtcaaacatgtcagaccaaggaccgtataatgaatatgaacccacccatgaaggacccttcatcatcattaatggttatggacagtgcaagtgtcagcagctgccatacaaagaatgtgaagtataatatctacccatcatcaaaaatcacatcagataagtaacctattttacatagtagaggctaaatacatatctaatttttaccaatggtgacattaagcctaattttccaaactaagtggagacttagtttttgaagtgttgaagtatttttaattttttaaatgaaaccatattttaagtgttaaatgaatcaatgctcacattaatttgcactcctgttggaaagtctaaaatgcttacttcaaaataagaaatgtatgtaattatatacaatcgtgtgtaaacctttacactaaggtctccatatactatttttttctactgaaaacaatttagaaagaagctattgggcagaaacagatatagatcaatacctgtttgatcactgctctccatcccatgtaccacaactatcttgctgcttaaaaggagacttagtaaagttctcttgtatgataatttggtatttactcaaatcttcaatttcttgccagggtgggaagtagaatttcatgtatgctgaagactggtaaatattaaacattctccttccaga

SEQ ID NO: 148249 - DNA, 4358 bp, Homo sapiens
  Payload ID: 9352
  Gene Symbol: LRRTM3
  Gene Name: leucine rich repeat transmembrane neuronal 3
  Uniprot ID: Q86VH5
  ENST ID: ENST00000361320
  CDS Start-End: 579-2324
acataagactgcattcactgaaaccaaagcaacagtccgagcagctttcagaatgacagtctgcagaagtgagctgagcgtgtgcgcggtacggggctctcctgccttctgggctccaacgcagctctgtggctgaactgggtgctcatcacgggaactgctggggtatggaatacagatgtggcagctcaggtagccccaaattgcctggaagaatacatcatgtttttcgataagaagaaattgtaggatccagttttttttttaaccgccccctccccaccccccaaaaaactgtaaagatgcaaaaacgtaatatccatgaagatcctattacctaggaagattttgatgttttgctgcgaatgcggtgttgggatttatttgttcttggagtgttctgcgtggctggcaaagaataatgttccaaaatcggtccatctcccaaggggtccaatttttcttcctgggtgtcagcgagccctgactcactacagtgcagctgacaggggctgtcatgcaactggcccctaagccaaagcaaaagacctaaggacgacctttgaacaatacaaaggatgggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccctgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgagatacctttatcaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacaaaacacaaaatcccctgttcaaataaacaaaaaatccaagattgattcatgaaataaagaagacatgaattgttttaagtctacactttgtaattagctaagttgtgcagtattttttgacttaaacagagtatgaccctgaaaaataaaagaatctttttttttcaaaactcatcctacctacctgtaaaaactgtacaaagctaatgtatttttcatattgtaaagtttcaattgtagaaacaactggtatgtacagtaccataatttaattacattttactttaaaaactttacacatttcagtttctaaaattttaaattaacaaaaattatttcttgtgttattcagagttactcagttttgtaaggactgttttgttactgcttttgtgcccagaaaccttgactctaaaattctgtgctgtgcgaaacatgcacgatttttattatgcttactgcgtagaattttatctacttgttccagaaataatacattaaccaaaaaggatttaattgttcagacttgtaagaggttcttcaattacataggcaggtttttcttaaaaatgaaaaaaaaatcaaagatttttttaacagttctcagacttaactgttgccttgaattacagcctagtttctaagcagtgaaatgtaatgataaagagggatattttaacatatttccgaatgaatgactcattatttcattcttttgagtaaccattgttaagggttgggggaaagcatggacaaaacatcactggaaacaaaggctgtaaccacagcaacagactttgtgatacagttaaaaggtgcagctgccagtgacaaataaaaacttttgttacatctcattattttcaggccaaggtgggagtatagtgcataataattgtacagtagcaatttttatcctaattaacccatagcggtttacctaaaagtaaccatcagtcagtgcaaaatgtgcctggttcttaagacaactttttatttagaactgtgagaccggtattttggaaacatttcaaaggaaacatatgaatttgttttgcgttgtgcactacatcatttctctcctgaggaagaattttaaacatgtacagctcattcaatatagatatgagccatggtggagaactttatcactcaagtagacggtaaacatccttaatatgttctaaattgtttatattgctatccataatgggattcacctccaaattatcaaagaaataactcagagtaatttgacaccagcccagatcatatattgattatacaattgtattataaagttcattcaaatcaaattaagaaaacctgagtctttagaagctgaaataatcaacttgtttgtgctgtttgcttgacataggttattgtttgaaaatattgttactttatcaatagtaatcatgcattcttgtgtttttttttaatggaaaactgcaagtttcaattactgttgcactagaagtgctttttatgttgtcattttatattcatgccatcaaaagtagattgacaatacatcaatctaacaggggccaatcaaaacaatgaagaaaagaataactgaaaacaatgtcaaacttttaaatttttatctcttccaaagaagttatatctataaaatctagttttatgcaggtttgtcacagcaaatgtaaaagcggattcaagaagaatgaacttaaaaactgtggagcaaatttttgttgaaaatatataaagtcagaaagaaaaaagatgtaaatgttggaagaagcaaattctattactaattcaaatgaaactaaatgtcaaacacagtacttgtgtcaactatttagcatcccagattttgtaacatattttgcataaattatttgctcttcaaaaatttttgtcattttaaatctaattttaatctttatgttttccattttctaa

SEQ ID NO: 148250 - DNA, 3616 bp, Homo sapiens
  Payload ID: 9353
  Gene Symbol: LRRTM4
  Gene Name: leucine rich repeat transmembrane neuronal 4
  Uniprot ID: Q86VH4
  ENST ID: ENST00000409088
  CDS Start-End: 416-1972
agtgtatcacaaactcaagcattagcaccaacaagctctgagcatcatcagtctctggaaagccttctgaattagacaagggctgcctcccagcacagctacaaaacactttaaacctgaccagctaaatggataaacctagcctgcatagcttttaaactggggtctcatacagcacaggaggcctacttgcttcaagaactgaaaatccagaggatgaattgctttatctgggaatggcaaaagccagcacaataaggaatgccagtttgtatggggctactagctcacatgcgggatcagaatggtgtgaatgacagccgcactgtgtcatgaaggtggtggtggtttccgcacaagagaccaaataagaagaaagctgagagaggggggaaacgtttttggatgacaaaggatgggtttccatttaattacgcagctgaaaggcatgagtgtggtgctggtgctacttcctacactgctgcttgttatgctcacgggtgctcagagagcttgcccaaagaactgcagatgtgatggcaaaattgtgtactgtgagtctcatgctttcgcagatatccctgagaacatttctggagggtcacaaggcttatcattaaggttcaacagcattcagaagctcaaatccaatcagtttgccggccttaaccagcttatatggctttatcttgaccataattacattagctcagtggatgaagatgcatttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgaggtatgaaccatgatcctcctaaaagcatttctactgcggggaaggagaggtaaatgtttgaagccctagaggtgtctctaatcactagaaagattaatgacccttttgcttttgggttttgctcagtgtgaaaggttacttaattaaattacaaccaccaggaaattgactgctttttttttttttttaaatggttgaaacttgaaggaagttcattcaaggataagttggaataaagcactatgttaaaacatctgctttttaacaatttgtatacaggggttggacttaaaaacacacatacaaacaaaactcttttcattctgaaatttctgtctggttcttggtgtttgactgttgtaatggagtaaagaagagggccagcttaatttaaaaataaagtgagtttaccaaaattccagaaggtaatgaagatttaaaccaaagagcaattttcccaagggttgattttgttgtaaatttttagttttaatgaaagcatgcaacagggatctcacacccatgttacttgccatttagttattataccagcatagagaatgtcagaggcctactgtgtaattgtatcaggctcctaaggcttctttctttttttttttttgtttccttctttcctactttctttcactccttcctttccttcctttctcttccttctttttttgtttgtttgtttgttttttaattactgggatatagatccgatttcaaaggtttttatgcactggctatttgtgtttaatcagaatgaaacttcaattccatgctttggctttgtccctggtaactaaaatcaggtcacaattttgtggatgatttagcaataataaaatggcagtcataacagggactgtttgtcagtattgctgtcatccccaaaagaaatgatatgtattcttgttaaacttattaaaaaataagtgatacaaatatttataaataaaaggagagaggtttgagttctgggtatcctccctttctgtaacagcctcaaataaaggtgtaccttccatgttatattatttttgtttttataagaataaatttggacccggtttctgattatttaatttaaaagatcacttacaggatcatgttagtgagcagacaaatagtcacaaatttcaaacttgtcaataagtaatgctggatgtaaattgttcttttcttggtaatgttgatcattatgtgcaaagactgactactaaggccttgttgctggaagaaactagtgaagagaggttaaattctggcaatataatgttttagtatctgattttagatgatcactctttcaaaagacagttttaatgagtaattaaagatgttgccctttctaatgctagttaacagttggaaaatataattgctctttgatagcatatactccaatttttccatagtcctaactacaaatgctaatgaaaatgttttcagacaaagcactgaatttgaaataatctctaactcagtacaatttggactattgaactgttcttcaaagaattcattttcttcttttttgtgtatcattgaaaataagagaagtaatcccagataataaattcctaaaaggaaactgtataagcaattgcccttaaaaattaaaaagaataaaagattttctat

SEQ ID NO: 148251 - DNA, 2451 bp, Homo sapiens
  Payload ID: 9353
  Gene Symbol: LRRTM4
  Gene Name: leucine rich repeat transmembrane neuronal 4
  ENST ID: ENST00000409282
  CDS Start-End: 96-1655
ctcatacagcacaggaggcctacttgcttcaagaactgaaaatccagaggatgaattgctttatctgggaatggcaaaagccagcacaataaggaatgccaggtttccatttaattacgcagctgaaaggcatgagtgtggtgctggtgctacttcctacactgctgcttgttatgctcacgggtgctcagagagcttgcccaaagaactgcagatgtgatggcaaaattgtgtactgtgagtctcatgctttcgcagatatccctgagaacatttctggagggtcacaaggcttatcattaaggttcaacagcattcagaagctcaaatccaatcagtttgccggccttaaccagcttatatggctttatcttgaccataattacattagctcagtggatgaagatgcatttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgaggtatgaaccatgatcctcctaaaagcatttctactgcggggaaggagaggtaaatgtttgaagccctagaggtgtctctaatcactagaaagattaatgacccttttgcttttgggttttgctcagtgtgaaaggttacttaattaaattacaaccaccaggaaattgactgctttttttttttttttaaatggttgaaacttgaaggaagttcattcaaggataagttggaataaagcactatgttaaaacatctgctttttaacaatttgtatacaggggttggacttaaaaacacacatacaaacaaaactcttttcattctgaaatttctgtctggttcttggtgtttgactgttgtaatggagtaaagaagagggccagcttaatttaaaaataaagtgagtttaccaaaattccagaaggtaatgaagatttaaaccaaagagcaattttcccaagggttgattttgttgtaaatttttagttttaatgaaagcatgcaacagggatctcacacccatgttacttgccatttagttattataccagcatagagaatgtcagaggcctactgtgtaattgtatcaggctcctaaggcttctttctttttttttttttgtttccttctttcctactttctttcactccttcctttccttcctttctcttccttctttttttgtttgtttgtttgttttttaattactgggatatagatccgatttcaaaggtttttatgcactggctatttgtgtttaatcagaatgaaacttcaattccatgctttggctttgtccc

SEQ ID NO: 148252 - DNA, 2247 bp, Homo sapiens
  Payload ID: 9353
  Gene Symbol: LRRTM4
  Gene Name: leucine rich repeat transmembrane neuronal 4
  Uniprot ID: Q86VH4
  ENST ID: ENST00000409093
  CDS Start-End: 338-2110
acaaactcaagcattagcaccaacaagctctgagcatcatcagtctctggaaagccttctgaattagacaagggctgcctcccagcacagctacaaaacactttaaacctgaccagctaaatggataaacctagcctgcatagcttttaaactggggtctcatacagcacaggaggcctacttgcttcaagaactgaaaatccagaggatgaattgctttatctgggaatggcaaaagccagcacaataaggaatgccaggtggtggtggtttccgcacaagagaccaaataagaagaaagctgagagaggggggaaacgtttttggatgacaaaggatgggtttccatttaattacgcagctgaaaggcatgagtgtggtgctggtgctacttcctacactgctgcttgttatgctcacgggtgctcagagagcttgcccaaagaactgcagatgtgatggcaaaattgtgtactgtgagtctcatgctttcgcagatatccctgagaacatttctggagggtcacaaggcttatcattaaggttcaacagcattcagaagctcaaatccaatcagtttgccggccttaaccagcttatatggctttatcttgaccataattacattagctcagtggatgaagatgcatttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgagatgccacaccacatgaagcccttgccatattacagctatgaccagcctgtgatcgggtactgccaggcccaccagccactccatgtcaccaagggctatgagacagtgtctccagagcaggacgaaagccccggcctggagctgggccgagaccacagcttcatcgccaccatcgccaggtcggcagcaccggccatctacctagagagaattgcaaactaacgctgaagccaactcctcactggggagctccatgggggggagggagggccttcatcttaaaggagaatgggtgtccacaatcgcgcaatcgagcaagctcatcgttcctgttaaaacatttatggcatagagaaaag

SEQ ID NO: 148253 - DNA, 2976 bp, Homo sapiens
  Payload ID: 9353
  Gene Symbol: LRRTM4
  Gene Name: leucine rich repeat transmembrane neuronal 4
  ENST ID: ENST00000409911
  CDS Start-End: 225-2000
ctgagcatcatcagtctctggaaagccttctgaattagacaagggctgcctcccagcacagctacaaaacactttaaacctgaccagctaaatggataaacctagcctgcatagcttttaaactggggtctcatacagcacaggaggcctacttgcttcaagaactgaaaatccagaggatgaattgctttatctgggaatggcaaaagccagcacaataaggaatgccaggtttccatttaattacgcagctgaaaggcatgagtgtggtgctggtgctacttcctacactgctgcttgttatgctcacgggtgctcagagagcttgcccaaagaactgcagatgtgatggcaaaattgtgtactgtgagtctcatgctttcgcagatatccctgagaacatttctggagggtcacaaggcttatcattaaggttcaacagcattcagaagctcaaatccaatcagtttgccggccttaaccagcttatatggctttatcttgaccataattacattagctcagtggatgaagatgcatttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgagatgccacaccacatgaagcccttgccatattacagctatgaccagcctgtgatcgggtactgccaggcccaccagccactccatgtcaccaagggctatgagacagtgtctccagagcaggacgaaagccccggcctggagctgggccgagaccacagcttcatcgccaccatcgccaggtcggcagcaccggccatctacctagagagaattgcaaactaacgctgaagccaactcctcactggggagctccatgggggggagggagggccttcatcttaaaggagaatgggtgtccacaatcgcgcaatcgagcaagctcatcgttcctgttaaaacatttatggcatagagaaaagaaaaagagaaaaaaaaactgcttgaagagggcagcgaatgcacctgcagcattaccgggaggactgcagaactttctttgctttaaaacataaaacaaacaaaaatgctcccggatgtaaatagtaagagtgtcaagttcttataaaaatagatttcaccctagctacatataggtttgtttgtatatttgatttttctacactgcatggttcctgggctggagaaccacaggggagcaaataaacaggggtgggtgggaagctagggaaacaaccgttttcctctttaggtgtgtgtaattctcacagattttatttaaattgctttcatttattttttctttaaaaatgctgtttgttcttgttttgtttgttttaatttttttctttcctggtcaagtttctaatacaaaacatgagcattaaagcttatgttgtaccaaaagaaaatgtgctttaccacggaccacggagaaagttgaccacaaagtttgacaaaactactggaaaacccaataagtctgggtgaatgacccttcatgacaaatgccatatatggtacatgatagaaggaattttgttttgtcccattggcagccctcactgtgtaggatgcctgagagagccatgaagatctccgaatgagaagaccagcagaatcattctcatgtggactaaggctataagagagatatgaccatgggctcaatgaatgaaactgccaagctgacaaatttctaaacacaagataatgtgtaacattgctttttaaattaattatcaattagcttttgtgtagtttttatcaataaaagaaaaaatattgaaaaataaatata

SEQ ID NO: 148254 - DNA, 2227 bp, Homo sapiens
  Payload ID: 9353
  Gene Symbol: LRRTM4
  Gene Name: leucine rich repeat transmembrane neuronal 4
  Uniprot ID: Q86VH4
  ENST ID: ENST00000409884
  CDS Start-End: 313-2085
aaacactttaaacctgaccagctaaatggataaacctagcctgcatagcttttaaactggggtctcatacagcacaggaggcctacttgcttcaagaactgaaaatccagaggatgaattgctttatctgggaatggcaaaagccagcacaataaggaatgccagtttgtatggggctactagctcacatgcgggatcagaatggtgtgaatgacagccgcactgtgtcatgaaggtggtggtggtttccgcacaagagaccaaataagaagaaagctgagagaggggggaaacgtttttggatgacaaaggatgggtttccatttaattacgcagctgaaaggcatgagtgtggtgctggtgctacttcctacactgctgcttgttatgctcacgggtgctcagagagcttgcccaaagaactgcagatgtgatggcaaaattgtgtactgtgagtctcatgctttcgcagatatccctgagaacatttctggagggtcacaaggcttatcattaaggttcaacagcattcagaagctcaaatccaatcagtttgccggccttaaccagcttatatggctttatcttgaccataattacattagctcagtggatgaagatgcatttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgagatgccacaccacatgaagcccttgccatattacagctatgaccagcctgtgatcgggtactgccaggcccaccagccactccatgtcaccaagggctatgagacagtgtctccagagcaggacgaaagccccggcctggagctgggccgagaccacagcttcatcgccaccatcgccaggtcggcagcaccggccatctacctagagagaattgcaaactaacgctgaagccaactcctcactggggagctccatgggggggagggagggccttcatcttaaaggagaatgggtgtccacaatcgcgcaatcgagcaagctcatcgttcctgttaaaacatttatggcatagagaaaagaaaaa

SEQ ID NO: 148255 - DNA, 485 bp, Homo sapiens
  Payload ID: 9353
  Gene Symbol: LRRTM4
  Gene Name: leucine rich repeat transmembrane neuronal 4
  ENST ID: ENST00000456154
  CDS Start-End: 412-485
aagactccgtgggcgtaggaccctccgagccaggtgagggatataatctcgtggtgccgttttttaagcccgtcgaaaatcgcagtattcgggtgggagtgacccgattttccagatgctgtctgtcacccctttctttgactaggaaagggaactccctgaccccttgcgcttcccgagtgaggcaatgcctcaccctgcttcggctcacgcacggtgcgcgcacccactgacctgcgcccactgtctggcactccctagtgagatgaacccagtacctcagatggaaatgcagaaatcacctgtcttctgtgtcgctcacactgagagctgtagaccggagcttttcctatttggccatcttgcgacaaagtgatcccaggtttccatttaattacgcagctgaaaggcatgagtgtggtgctggtgctacttcctacactgctgcttgttatgctcacgggtgctcagagagcttgcccaaa

SEQ ID NO: 148256 - DNA, 2332 bp, Homo sapiens
  Payload ID: 9354
  Gene Symbol: LRTOMT
  Gene Name: leucine rich transmembrane and O-methyltransferase domain containing
  Uniprot ID: Q96E66
  ENST ID: ENST00000289488
  CDS Start-End: 379-957
agagaaggggtatcaccgcttccggaccccggcctgtacttgaaggcaaagagaactacaaatcccagcgtcacccgcggccttgaagccccgcccctgacaaactgaaggtcccggtaagcatcgcgtcagtacttatggcgcctgccgggttgtggtgacgaaagcagttgccatggagttgctctgagtaaccctgaggcagtgggacgccaagactggagaggaagcgactgcggggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttcttttttttttttttgagacggagtctcactctgtcacacaggctggagtgcagtggcacgatcttggctcactgcaacctcagcctcccaggttcaagagattctcctgcctcagcctccccagtagctgtgattaaaggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaatttttttttttgagacggagtctcgctctgtcacccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgctgaaaaagggaggcaattgagggaaaggcctgctggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaa

SEQ ID NO: 148257 - DNA, 3604 bp, Homo sapiens
  Payload ID: 9354
  Gene Symbol: LRTOMT
  Gene Name: leucine rich transmembrane and O-methyltransferase domain containing
  Uniprot ID: Q8WZ04
  ENST ID: ENST00000307198
  CDS Start-End: 877-1752
ctgccctttcggactcggttatggaggaggccttccgctcgcagcggcctctccagcaccccttttaggcctgagcacccgcaggggtgcccaggccgcacgccaaacgcgggcccgcgccggttacctggctgcgcgctcccgctctgcctcgcgattctccggaatcgtacctcttcgtgggctcgcgccagcgctgtgagcgcacaattagtttaaactatggccccgccccctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccggtaagcatcgcgtcagtacttatggcgcctgccgggttgtggtgacgaaagcagttgccatggagttgctctgagtaaccctgaggcagtgggacgccaagactggagaggaagcgactgcggatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtatagcaggccctggactccccgacctgtcctgtgctctggtcctccagcccagggcccaggtagggaccatgtcccctgccattgcattggccttcctgccactggtggtaacattgctggtgcggtaccggcactacttccgattgctggtgcgcacggtcttgctgcgaagcctccgagactgcctgtcagggctgcggatcgaggagcgggccttcagctacgtgctcacccatgccctgcccggtgaccctggtcacatcctcaccaccctggaccactggagcagccgctgcgagtacttgagccacatggggcctgtcaaaggtcagatcctgatgcggctggtggaggagaaggcccctgcttgtgtgctggaattgggaacctactgtggatactctaccctgcttattgcccgagccctgccccctgggggtcgccttcttactgtggagcgggacccacgcacggcagcagtggctgaaaaactcatccgcctggccggctttgatgagcacatggtggagctcatcgtgggcagctcagaggacgtgatcccgtgcctacgcacccagtatcagctgagtcgggcagacctggtgctcctggcacaccggccacgatgttacctgagggacctgcagctgctggaggcccatgccctactgccagcaggtgccaccgtgctggctgaccatgtgctcttccctggtgcaccccgcttcttgcagtatgctaagagctgtggccgctaccgctgccgcctccaccacactggccttccagacttccctgccatcaaggatggaatagctcagctcacctatgctggaccaggctgaggtccaggcccaggggtacttactgatgcccacccccacccccacccaagcagggacctcaaaatcccctccctttcctgtttggggccttgacacacgctgggctcagggctagggagtctctcttcccacctctgacctctttcagcctctacactgacctcaagtgtcaagttctatcaggctgcttggtctcactaggccccctctttccagagagaaccatggactgacagcaagaagcctgagctcccgacccagctctgtcactgatttgctgagtgactccaagggaatccccaccttgctctgagatttaatcttctctcttaacacgaaggaagctggatgggagagctccaggggcctcccagttctcggcctcagaaagcctcccatcctcagcccatgccattctgggtgggatcagaggaagtggcaatgagttagacgccctgcaggaatagctggatgcaagctgggccagagaaaatggcacagaaccctggacccagggccagggatgccctggccttccctaactctggcccacctagccaattaggtgtggctgatgtcccttgagtgccctcttcctaaagcccaaaagaagatgctggactcctctgggccccaccaacaaatagggaatagacatgggtggaaaatcactcctttgtctttattaaagaaacttagaccagacctggcaatcaaggggtgaggtactggccaggaaggtggagtaggtttcaggccctggggatttcaagtgcagactgatggcctgggaggggccaaagagaccagatcctggcagcagctgaggaggtgcccaagggcactttcaggcactggggccatcagctggttctgtgggcaggggttgggggttgggatgcagggtagtttgggctggcctggaatctccctgaggccaccctgccttgtctacctagatcatccactggtcctgatcctgttcgttgccttccatgtccacctggagaggaggctgggtgtgggtggggaggggcctcagccagcctcagccccagatcctgcccctggctggatccagggtttctgtaccccttggccatcaactgggtcaggagcaagggtccaggaacagaggccctcccccataccccttgcctacctcattgacctctccatcatccggtgactcattgtagtcattcatctcgtccatgtcctgcatatcctcatcatcctctgagtcctcttcactatcctcatcatcttcatcatcctcttcttcctcgtcatcatagtgctggtgggcaggacagagcctgtaagccctacaggcctgcatggaccagttcaagaactgacccacttgagcctctctctagggccaatgaatgaccccctaccccgacactccctccttgagtctagcaggctggtgcatgttctgcaggaccttaatgctaggcccaatgcccaccccttctatctccccttttaggcttttacccagatctgagaaccacaactgctctgggtcagagacaggacattcagaattagagcagagcctcggtccactgcggcccccacacaggccccacctgctagagccactcacctctgaggctggcttgccaataggaaccaggttgttgtctttctccgcgatgctttggagctgtgggcaaaggcacagaggaacaaggccagagcccaagtagggcaggtcaggggcatgggactggcccattctgcccagaagacaacccacacgtgttggggagaagcttcctcccagttctcagggagatacaatccctttcttgtcatctgccatttatgaacttgatcc

SEQ ID NO: 148258 - DNA, 253 bp, Homo sapiens
  Payload ID: 9354
  Gene Symbol: LRTOMT
  Gene Name: leucine rich transmembrane and O-methyltransferase domain containing
  ENST ID: ENST00000440313
  CDS Start-End: 74-217
ggcaacagcatccagcgcctgggggaggtgaataagctggctgtccttcctcggctccgtagcctgacactccatgggaaccccatggaggaagagaaagggtatagacggagtctcactctgtcacacaggctggagtgcagtggcacgatcttggctcactgcaacctcagcctcccaggttcaagagattctcctgcctcagcctccccagtagctgtgattaaaggcgcctgccaccatgactggctaa

SEQ ID NO: 148259 - DNA, 2685 bp, Homo sapiens
  Payload ID: 9354
  Gene Symbol: LRTOMT
  Gene Name: leucine rich transmembrane and O-methyltransferase domain containing
  ENST ID: ENST00000419228
  CDS Start-End: 79-546
ttcacggcaacagcatccagcgcctgggggaggtgaataagctggctgtccttcctcggctccgtagcctgacactccatgggaaccccatggaggaagagaaagggtatagcaggccctggactccccgacctgtcctgtgctctggtcctccagcccagcctccgagactgcctgtcagggctgcggatcgaggagcgggccttcagctacgtgctcacccatgccctgcccggtgaccctggtcacatcctcaccaccctggaccactggagcagccgctgcgagtacttgagccacatggggcctgtcaaaggtcagatcctgatgcggctggtggaggagaagcccctgcttgtgtgctggaattgggaacctactgtggatactctaccctgcttattgcccgagccctgccccctgggggtcgccttcttactgtggagcgggacccacgcacggcagcagtggctgaaaaactcatccgcctggccggctttgatgagcacatggtggagctcatcgtgggcagctcagaggacgtgatcccgtgcctacgcacccagtatcagctgagtcgggcagacctggtgctcctggcacaccggccacgatgttacctgagggacctgcagctgctggaggcccatgccctactgccagcaggtgccaccgtgctggctgaccatgtgctcttccctggtgcaccccgcttcttgcagtatgctaagagctgtggccgctaccgctgccgcctccaccacactggccttccagacttccctgccatcaaggatggaatagctcagctcacctatgctggaccaggctgaggtccaggcccaggggtacttactgatgcccacccccacccccacccaagcagggacctcaaaatcccctccctttcctgtttggggccttgacacacgctgggctcagggctagggagtctctcttcccacctctgacctctttcagcctctacactgacctcaagtgtcaagttctatcaggctgcttggtctcactaggccccctctttccagagagaaccatggactgacagcaagaagcctgagctcccgacccagctctgtcactgatttgctgagtgactccaagggaatccccaccttgctctgagatttaatcttctctcttaacacgaaggaagctggatgggagagctccaggggcctcccagttctcggcctcagaaagcctcccatcctcagcccatgccattctgggtgggatcagaggaagtggcaatgagttagacgccctgcaggaatagctggatgcaagctgggccagagaaaatggcacagaaccctggacccagggccagggatgccctggccttccctaactctggcccacctagccaattaggtgtggctgatgtcccttgagtgccctcttcctaaagcccaaaagaagatgctggactcctctgggccccaccaacaaatagggaatagacatgggtggaaaatcactcctttgtctttattaaagaaacttagaccagacctggcaatcaaggggtgaggtactggccaggaaggtggagtaggtttcaggccctggggatttcaagtgcagactgatggcctgggaggggccaaagagaccagatcctggcagcagctgaggaggtgcccaagggcactttcaggcactggggccatcagctggttctgtgggcaggggttgggggttgggatgcagggtagtttgggctggcctggaatctccctgaggccaccctgccttgtctacctagatcatccactggtcctgatcctgttcgttgccttccatgtccacctggagaggaggctgggtgtgggtggggaggggcctcagccagcctcagccccagatcctgcccctggctggatccagggtttctgtaccccttggccatcaactgggtcaggagcaagggtccaggaacagaggccctcccccataccccttgcctacctcattgacctctccatcatccggtgactcattgtagtcattcatctcgtccatgtcctgcatatcctcatcatcctctgagtcctcttcactatcctcatcatcttcatcatcctcttcttcctcgtcatcatagtgctggtgggcaggacagagcctgtaagccctacaggcctgcatggaccagttcaagaactgacccacttgagcctctctctagggccaatgaatgaccccctaccccgacactccctccttgagtctagcaggctggtgcatgttctgcaggaccttaatgctaggcccaatgcccaccccttctatctccccttttaggcttttacccagatctgagaaccacaactgctctgggtcagagacaggacattcagaattagagcagagcctcggtccactgcggcccccacacaggccccacctgctagagccactcacctctgaggctggcttgccaataggaaccaggttgttgtctttctccgcgatgctttggagctgtgggcaaaggcacagaggaacaaggccagagcccaagtagggcaggtcaggggcatgggactggcccattctgcccagaagacaacccacacgtgttggggagaagcttcctcccagttctcagggagatacaatccctttcttgtcatctgccatttatgaacttgatcc

SEQ ID NO: 148260 - DNA, 801 bp, Homo sapiens
  Payload ID: 9354
  Gene Symbol: LRTOMT
  Gene Name: leucine rich transmembrane and O-methyltransferase domain containing
  ENST ID: ENST00000439209
  CDS Start-End: 167-637
ccaagactggagaggaagcgactgcggggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggtggagctcatcgtgggcagctcagaggacgtgatcccgtgcctacgcacccagtatcagctgagtcgggcagacctggtgctcctggcacaccggccacgatgttacctgagggacctgcagctgctggaggcccatgccctactgccagcaggtgccaccgtgctggctgaccatgtgctcttccctggtgcaccc

SEQ ID NO: 148261 - DNA, 3299 bp, Homo sapiens
  Payload ID: 9354
  Gene Symbol: LRTOMT
  Gene Name: leucine rich transmembrane and O-methyltransferase domain containing
  Uniprot ID: Q96E66
  ENST ID: ENST00000427369
  CDS Start-End: 167-850
ccaagactggagaggaagcgactgcggggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtatagcaggccctggactccccgacctgtcctgtgctctggtcctccagcccagggcccaggtagggaccatgtcccctgccattgcattggccttcctgccactggtggtaacattgctggtgcggtaccggcactacttccgattgctggtgcgcacggtcttgctgcgaagcctccgagactgcctgtcagggctgcggatcgaggagcgggccttcagctacgtgctcacccatgccctgcccggtgaccctggtcacatcctcaccaccctggaccactggagcagccgctgcgagtacttgagccacatggggcctgtcaaaggtcagatcctgatgcggctggtggaggagaaggcccctgcttgtgtgctggaattgggaacctactgtggatactctaccctgcttattgcccgagccctgccccctgggggtcgccttcttactgtggagcgggacccacgcacggcagcagtggctgaaaaactcatccgcctggccggctttgatgagcacatggtggagctcatcgtgggcagctcagaggacgtgatcccgtgcctacgcacccagtatcagctgagtcgggcagacctggtgctcctggcacaccggccacgatgttacctgagggacctgcagctgctggaggcccatgccctactgccagcaggtgccaccgtgctggctgaccatgtgctcttccctggtgcaccccgcttcttgcagtatgctaagagctgtggccgctaccgctgccgcctccaccacactggccttccagacttccctgccatcaaggatggaatagctcagctcacctatgctggaccaggctgaggtccaggcccaggggtacttactgatgcccacccccacccccacccaagcagggacctcaaaatcccctccctttcctgtttggggccttgacacacgctgggctcagggctagggagtctctcttcccacctctgacctctttcagcctctacactgacctcaagtgtcaagttctatcaggctgcttggtctcactaggccccctctttccagagagaaccatggactgacagcaagaagcctgagctcccgacccagctctgtcactgatttgctgagtgactccaagggaatccccaccttgctctgagatttaatcttctctcttaacacgaaggaagctggatgggagagctccaggggcctcccagttctcggcctcagaaagcctcccatcctcagcccatgccattctgggtgggatcagaggaagtggcaatgagttagacgccctgcaggaatagctggatgcaagctgggccagagaaaatggcacagaaccctggacccagggccagggatgccctggccttccctaactctggcccacctagccaattaggtgtggctgatgtcccttgagtgccctcttcctaaagcccaaaagaagatgctggactcctctgggccccaccaacaaatagggaatagacatgggtggaaaatcactcctttgtctttattaaagaaacttagaccagacctggcaatcaaggggtgaggtactggccaggaaggtggagtaggtttcaggccctggggatttcaagtgcagactgatggcctgggaggggccaaagagaccagatcctggcagcagctgaggaggtgcccaagggcactttcaggcactggggccatcagctggttctgtgggcaggggttgggggttgggatgcagggtagtttgggctggcctggaatctccctgaggccaccctgccttgtctacctagatcatccactggtcctgatcctgttcgttgccttccatgtccacctggagaggaggctgggtgtgggtggggaggggcctcagccagcctcagccccagatcctgcccctggctggatccagggtttctgtaccccttggccatcaactgggtcaggagcaagggtccaggaacagaggccctcccccataccccttgcctacctcattgacctctccatcatccggtgactcattgtagtcattcatctcgtccatgtcctgcatatcctcatcatcctctgagtcctcttcactatcctcatcatcttcatcatcctcttcttcctcgtcatcatagtgctggtgggcaggacagagcctgtaagccctacaggcctgcatggaccagttcaagaactgacccacttgagcctctctctagggccaatgaatgaccccctaccccgacactccctccttgagtctagcaggctggtgcatgttctgcaggaccttaatgctaggcccaatgcccaccccttctatctccccttttaggcttttacccagatctgagaaccacaactgctctgggtcagagacaggacattcagaattagagcagagcctcggtccactgcggcccccacacaggccccacctgctagagccactcacctctgaggctggcttgccaataggaaccaggttgttgtctttctccgcgatgctttggagctgtgggcaaaggcacagaggaacaaggccagagcccaagtagggcaggtcaggggcatgggactggcccattctgcccagaagacaacccacacgtgttggggagaagcttcctcccagttctcagggagatacaatccctttcttgtcatctgccatttatgaacttgatccaa

SEQ ID NO: 148262 - DNA, 3194 bp, Homo sapiens
  Payload ID: 9354
  Gene Symbol: LRTOMT
  Gene Name: leucine rich transmembrane and O-methyltransferase domain containing
  Uniprot ID: Q8WZ04
  ENST ID: ENST00000435085
  CDS Start-End: 462-1337
caggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtatagcaggccctggactccccgacctgtcctgtgctctggtcctccagcccagggcccaggtagggaccatgtcccctgccattgcattggccttcctgccactggtggtaacattgctggtgcggtaccggcactacttccgattgctggtgcgcacggtcttgctgcgaagcctccgagactgcctgtcagggctgcggatcgaggagcgggccttcagctacgtgctcacccatgccctgcccggtgaccctggtcacatcctcaccaccctggaccactggagcagccgctgcgagtacttgagccacatggggcctgtcaaaggtcagatcctgatgcggctggtggaggagaaggcccctgcttgtgtgctggaattgggaacctactgtggatactctaccctgcttattgcccgagccctgccccctgggggtcgccttcttactgtggagcgggacccacgcacggcagcagtggctgaaaaactcatccgcctggccggctttgatgagcacatggtggagctcatcgtgggcagctcagaggacgtgatcccgtgcctacgcacccagtatcagctgagtcgggcagacctggtgctcctggcacaccggccacgatgttacctgagggacctgcagctgctggaggcccatgccctactgccagcaggtgccaccgtgctggctgaccatgtgctcttccctggtgcaccccgcttcttgcagtatgctaagagctgtggccgctaccgctgccgcctccaccacactggccttccagacttccctgccatcaaggatggaatagctcagctcacctatgctggaccaggctgaggtccaggcccaggggtacttactgatgcccacccccacccccacccaagcagggacctcaaaatcccctccctttcctgtttggggccttgacacacgctgggctcagggctagggagtctctcttcccacctctgacctctttcagcctctacactgacctcaagtgtcaagttctatcaggctgcttggtctcactaggccccctctttccagagagaaccatggactgacagcaagaagcctgagctcccgacccagctctgtcactgatttgctgagtgactccaagggaatccccaccttgctctgagatttaatcttctctcttaacacgaaggaagctggatgggagagctccaggggcctcccagttctcggcctcagaaagcctcccatcctcagcccatgccattctgggtgggatcagaggaagtggcaatgagttagacgccctgcaggaatagctggatgcaagctgggccagagaaaatggcacagaaccctggacccagggccagggatgccctggccttccctaactctggcccacctagccaattaggtgtggctgatgtcccttgagtgccctcttcctaaagcccaaaagaagatgctggactcctctgggccccaccaacaaatagggaatagacatgggtggaaaatcactcctttgtctttattaaagaaacttagaccagacctggcaatcaaggggtgaggtactggccaggaaggtggagtaggtttcaggccctggggatttcaagtgcagactgatggcctgggaggggccaaagagaccagatcctggcagcagctgaggaggtgcccaagggcactttcaggcactggggccatcagctggttctgtgggcaggggttgggggttgggatgcagggtagtttgggctggcctggaatctccctgaggccaccctgccttgtctacctagatcatccactggtcctgatcctgttcgttgccttccatgtccacctggagaggaggctgggtgtgggtggggaggggcctcagccagcctcagccccagatcctgcccctggctggatccagggtttctgtaccccttggccatcaactgggtcaggagcaagggtccaggaacagaggccctcccccataccccttgcctacctcattgacctctccatcatccggtgactcattgtagtcattcatctcgtccatgtcctgcatatcctcatcatcctctgagtcctcttcactatcctcatcatcttcatcatcctcttcttcctcgtcatcatagtgctggtgggcaggacagagcctgtaagccctacaggcctgcatggaccagttcaagaactgacccacttgagcctctctctagggccaatgaatgaccccctaccccgacactccctccttgagtctagcaggctggtgcatgttctgcaggaccttaatgctaggcccaatgcccaccccttctatctccccttttaggcttttacccagatctgagaaccacaactgctctgggtcagagacaggacattcagaattagagcagagcctcggtccactgcggcccccacacaggccccacctgctagagccactcacctctgaggctggcttgccaataggaaccaggttgttgtctttctccgcgatgctttggagctgtgggcaaaggcacagaggaacaaggccagagcccaagtagggcaggtcaggggcatgggactggcccattctgcccagaagacaacccacacgtgttggggagaagcttcctcccagttctcagggagatacaatccctttcttgtcatctgccatttatgaacttgatccaaata

SEQ ID NO: 148263 - DNA, 2007 bp, Homo sapiens
  Payload ID: 9354
  Gene Symbol: LRTOMT
  Gene Name: leucine rich transmembrane and O-methyltransferase domain containing
  Uniprot ID: Q96E66
  ENST ID: ENST00000447974
  CDS Start-End: 59-637
caggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttcttttttttttttttgagacggagtctcactctgtcacacaggctggagtgcagtggcacgatcttggctcactgcaacctcagcctcccaggttcaagagattctcctgcctcagcctccccagtagctgtgattaaaggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaatttttttttttgagacggagtctcgctctgtcacccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgctgaaaaagggaggcaattgagggaaaggcctgctggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgctt

SEQ ID NO: 148264 - DNA, 1263 bp, Homo sapiens
  Payload ID: 9354
  Gene Symbol: LRTOMT
  Gene Name: leucine rich transmembrane and O-methyltransferase domain containing
  ENST ID: ENST00000535883
  CDS Start-End: 460-576
ctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccggtaagcatcgcgtcagtacttatggcgcctgccgggttgtggtgacgaaagcagttgccatggagttgctctgagtaaccctgaggcagtgggacgccaagactggagaggaagcgactgcggggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagcaaatctgaaaggaaacagggggctatcacagtagttgatcatctttaaaagaagccaggctacagcaggaaagtcaagtggaagaaaactgggaagccagtctatcagccaatagttttattctcctgtttttacctgaagagaggaggaaaacacaggctcctgtggagtcccagcaaatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagc

SEQ ID NO: 148265 - DNA, 428 bp, Homo sapiens
  Payload ID: 9354
  Gene Symbol: LRTOMT
  Gene Name: leucine rich transmembrane and O-methyltransferase domain containing
  ENST ID: ENST00000539587
  CDS Start-End: 176-307
agttgctctgagtaaccctgaggcagtgggacgccaagactggagaggaagcgactgcgggtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttga

SEQ ID NO: 148266 - DNA, 308 bp, Homo sapiens
  Payload ID: 9354
  Gene Symbol: LRTOMT
  Gene Name: leucine rich transmembrane and O-methyltransferase domain containing
  ENST ID: ENST00000537483
  CDS Start-End: 113-308
atccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaaggtcagcccccagagcacagtactccactcactaaggcagcaggcccagtgtggtccctaggaagaaaccataatctacttaaaagcctaaagagattcttcccatatgcttgca

SEQ ID NO: 148267 - DNA, 726 bp, Homo sapiens
  Payload ID: 9354
  Gene Symbol: LRTOMT
  Gene Name: leucine rich transmembrane and O-methyltransferase domain containing
  Uniprot ID: Q96E66
  ENST ID: ENST00000541614
  CDS Start-End: 117-593
aacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtatagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaa

SEQ ID NO: 148268 - DNA, 842 bp, Homo sapiens
  Payload ID: 9354
  Gene Symbol: LRTOMT
  Gene Name: leucine rich transmembrane and O-methyltransferase domain containing
  ENST ID: ENST00000538413
  CDS Start-End: 566-842
tttcggactcggttatggaggaggccttccgctcgcagcggcctctccagcaccccttttaggcctgagcacccgcaggggtgcccaggccgcacgccaaacgcgggcccgcgccggttacctggctgcgcgctcccgctctgcctcgcgattctccggaatcgtacctcttcgtgggctcgcgccagcgctgtgagcgcacaattagtttaaactatggccccgccccctcgcgctgccctctgattggcctctgtcggcggggcccgcttaaggacccgggaaaaggaagtttgagggccactgggaaagagaaggggtatcaccgcttccggaccccggcctgtacttgaaggcaaagagaactacaaatcccagcgtcacccgcggccttgaagccccgcccctgacaaactgaaggtcccgggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgactt

SEQ ID NO: 148269 - DNA, 527 bp, Homo sapiens
  Payload ID: 9354
  Gene Symbol: LRTOMT
  Gene Name: leucine rich transmembrane and O-methyltransferase domain containing
  ENST ID: ENST00000542846
  CDS Start-End: 217-527
ctatattccaagcagacagagctggaaggagacactgttccacttagaggcccagtggcaggtgcagggaacttatgggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacct

SEQ ID NO: 148270 - DNA, 2402 bp, Homo sapiens
  Payload ID: 9354
  Gene Symbol: LRTOMT
  Gene Name: leucine rich transmembrane and O-methyltransferase domain containing
  Uniprot ID: Q96E66
  ENST ID: ENST00000324866
  CDS Start-End: 167-607
ccaagactggagaggaagcgactgcggggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggtaagtgccctgcccctggaggtagcgtctagctgggctcccctaaaggaaaggaggaggagaaacaagaaatctacgaccattcttctgccatgcttggacctgggaagggagtaacagacctctaagcattccttgctctcagtcaggataaacctaatctttcccaaactatgctcaagtccctccattccttgcagtcagggaagacaacagcaactagtggagggggaaggggattctggtgggggtgctggcccccagcctaagtcttccccacaggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttcttttttttttttttgagacggagtctcactctgtcacacaggctggagtgcagtggcacgatcttggctcactgcaacctcagcctcccaggttcaagagattctcctgcctcagcctccccagtagctgtgattaaaggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaatttttttttttgagacggagtctcgctctgtcacccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgctgaaaaagggaggcaattgagggaaaggcctgctggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgcttaaaaa

SEQ ID NO: 148271 - DNA, 3182 bp, Homo sapiens
  Payload ID: 9354
  Gene Symbol: LRTOMT
  Gene Name: leucine rich transmembrane and O-methyltransferase domain containing
  Uniprot ID: Q96E66
  ENST ID: ENST00000544409
  CDS Start-End: 167-730
ccaagactggagaggaagcgactgcggggagtatttccattttaaccggaaacaatccctgaacccacaggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtatagcaggccctggactccccgacctgtcctgtgctctggtcctccagcccagcctccgagactgcctgtcagggctgcggatcgaggagcgggccttcagctacgtgctcacccatgccctgcccggtgaccctggtcacatcctcaccaccctggaccactggagcagccgctgcgagtacttgagccacatggggcctgtcaaaggtcagatcctgatgcggctggtggaggagaaggcccctgcttgtgtgctggaattgggaacctactgtggatactctaccctgcttattgcccgagccctgccccctgggggtcgccttcttactgtggagcgggacccacgcacggcagcagtggctgaaaaactcatccgcctggccggctttgatgagcacatggtggagctcatcgtgggcagctcagaggacgtgatcccgtgcctacgcacccagtatcagctgagtcgggcagacctggtgctcctggcacaccggccacgatgttacctgagggacctgcagctgctggaggcccatgccctactgccagcaggtgccaccgtgctggctgaccatgtgctcttccctggtgcaccccgcttcttgcagtatgctaagagctgtggccgctaccgctgccgcctccaccacactggccttccagacttccctgccatcaaggatggaatagctcagctcacctatgctggaccaggctgaggtccaggcccaggggtacttactgatgcccacccccacccccacccaagcagggacctcaaaatcccctccctttcctgtttggggccttgacacacgctgggctcagggctagggagtctctcttcccacctctgacctctttcagcctctacactgacctcaagtgtcaagttctatcaggctgcttggtctcactaggccccctctttccagagagaaccatggactgacagcaagaagcctgagctcccgacccagctctgtcactgatttgctgagtgactccaagggaatccccaccttgctctgagatttaatcttctctcttaacacgaaggaagctggatgggagagctccaggggcctcccagttctcggcctcagaaagcctcccatcctcagcccatgccattctgggtgggatcagaggaagtggcaatgagttagacgccctgcaggaatagctggatgcaagctgggccagagaaaatggcacagaaccctggacccagggccagggatgccctggccttccctaactctggcccacctagccaattaggtgtggctgatgtcccttgagtgccctcttcctaaagcccaaaagaagatgctggactcctctgggccccaccaacaaatagggaatagacatgggtggaaaatcactcctttgtctttattaaagaaacttagaccagacctggcaatcaaggggtgaggtactggccaggaaggtggagtaggtttcaggccctggggatttcaagtgcagactgatggcctgggaggggccaaagagaccagatcctggcagcagctgaggaggtgcccaagggcactttcaggcactggggccatcagctggttctgtgggcaggggttgggggttgggatgcagggtagtttgggctggcctggaatctccctgaggccaccctgccttgtctacctagatcatccactggtcctgatcctgttcgttgccttccatgtccacctggagaggaggctgggtgtgggtggggaggggcctcagccagcctcagccccagatcctgcccctggctggatccagggtttctgtaccccttggccatcaactgggtcaggagcaagggtccaggaacagaggccctcccccataccccttgcctacctcattgacctctccatcatccggtgactcattgtagtcattcatctcgtccatgtcctgcatatcctcatcatcctctgagtcctcttcactatcctcatcatcttcatcatcctcttcttcctcgtcatcatagtgctggtgggcaggacagagcctgtaagccctacaggcctgcatggaccagttcaagaactgacccacttgagcctctctctagggccaatgaatgaccccctaccccgacactccctccttgagtctagcaggctggtgcatgttctgcaggaccttaatgctaggcccaatgcccaccccttctatctccccttttaggcttttacccagatctgagaaccacaactgctctgggtcagagacaggacattcagaattagagcagagcctcggtccactgcggcccccacacaggccccacctgctagagccactcacctctgaggctggcttgccaataggaaccaggttgttgtctttctccgcgatgctttggagctgtgggcaaaggcacagaggaacaaggccagagcccaagtagggcaggtcaggggcatgggactggcccattctgcccagaagacaacccacacgtgttggggagaagcttcctcccagttctcagggagatacaatccctttcttgtcatctgccatttatgaacttgatccaaata

SEQ ID NO: 148272 - DNA, 1270 bp, Homo sapiens
  Payload ID: 9354
  Gene Symbol: LRTOMT
  Gene Name: leucine rich transmembrane and O-methyltransferase domain containing
  Uniprot ID: Q96E66
  ENST ID: ENST00000423494
  CDS Start-End: 131-655
agcagttgccatggagttgctctgagtaaccctgaggcagtgggacgccaagactggagaggaagcgactgcggggagtatttccattttaaccggaaacaatccctgaacccacaggaatgaatgcctaatggtggagtttcagccatcagtgacagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttcttttttttttttttgagacggagtctcactctgtcacacaggctggagtgcagtggcacgatcttggctcactgcaacctcagcctcccaggttcaagagattctcctgcctcagcctccccagtagctgtgattaaaggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaatttttttttttgagacggagtctcgctctgtcacccaggctggagtgcagtggcacgatctcggctcactgcaaactccgccttccaggttcacgccattctcctgcctcagcctcccaagtagct

SEQ ID NO: 148273 - DNA, 570 bp, Homo sapiens
  Payload ID: 9354
  Gene Symbol: LRTOMT
  Gene Name: leucine rich transmembrane and O-methyltransferase domain containing
  ENST ID: ENST00000539271
  CDS Start-End: 431-562
agtacttatggcgcctgccgggttgtggtgacgaaagcagttgccatggagttgctctgagtaaccctgaggcagtgggacgccaagactggagaggaagcgactgcggatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaag

SEQ ID NO: 148274 - DNA, 579 bp, Homo sapiens
  Payload ID: 9354
  Gene Symbol: LRTOMT
  Gene Name: leucine rich transmembrane and O-methyltransferase domain containing
  Uniprot ID: Q96E66
  ENST ID: ENST00000536917
  CDS Start-End: 18-458
gaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggtaagtgccctgcccctggaggtagcgtctagctgggctcccctaaaggaaaggaggaggagaaacaagaaatctacgaccattcttctgccatgcttggacctgggaagggagtaacagacctc

SEQ ID NO: 148275 - DNA, 814 bp, Homo sapiens
  Payload ID: 9354
  Gene Symbol: LRTOMT
  Gene Name: leucine rich transmembrane and O-methyltransferase domain containing
  Uniprot ID: Q96E66
  ENST ID: ENST00000538478
  CDS Start-End: 138-716
gaggcagtgggacgccaagactggagaggaagcgactgcgggaatgaatgcctaatggtggagtttcagccatcagtgacaggctgaacccagactcccagggcacctgcttgcacctttgaatgatggcctgaactatgaacaaacgggactatatgaacacttcggtacaggagccccctcttgactactccttcagaagcatccacgtcattcaagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttaca

SEQ ID NO: 148276 - DNA, 1895 bp, Homo sapiens
  Payload ID: 9354
  Gene Symbol: LRTOMT
  Gene Name: leucine rich transmembrane and O-methyltransferase domain containing
  Uniprot ID: Q96E66
  ENST ID: ENST00000615940
  CDS Start-End: 1-525
atggtggagtttcagccatcagtgacagatctggtaaatgaggagccaaggacaggactacgaccactgaagcgttcaaagtcggggaaatcactgacccagtccctgtggctgaataacaatgttctcaatgatctgagagacttcaaccaggtggcttcacagctgttggagcacccagagaacctggcctggatcgacctgtcctttaatgacctgacttccattgaccctgtcctaacaactttcttcaacctgagtgtcctctatcttcacggcaacagcatccagcgcctgggggaggtgaataagctggctgtccttcctcggctccgtagcctgacactccatgggaaccccatggaggaagagaaagggtataggcaatatgtgctgtgcaccctgtcccgtatcaccacgttcgacttcagtggggtcaccaaagcagaccgcaccacagctgaagtctggaaacgcatgaacatcaagcccaagaaggcctggaccaagcagaatacactttgaggctcccacgaccctagtagtcctaaaggcctaagcatagacagcatggtttgacaataaataatttgagctgttgagcagatgagaagtcacttacaccttgtagagatgttctctaactcaggcaactgcaagtagctctagccttttcttttcttttttttttttttgagacggagtctcactctgtcacacaggctggagtgcagtggcacgatcttggctcactgcaacctcagcctcccaggttcaagagattctcctgcctcagcctccccagtagctgtgattaaaggcgcctgccaccatgactggctaattttgttgttgttgttgttgttttgagacggtttcactcgtcaccccagctggagtgcagtggtgcgatctcagctcactgcaacctccgcctgctgggttcaagcgattctcctgcctcagcctcctgagtagctgggattacaggcgcctgctaccacatccagctaatttttttttttgagacggagtctcgctctgtcacccaggctggagtgcagtggcacgatctcggctcactgcaaactccgccttccaggttcacgccattctcctgcctcagcctcccaagtagctgggactataggcacctactaccacgcctggctaattttttgtatttttagtagagacggggtttcaccatgttagccaggatggtctccatctcctgaccttgtgatccacccacctcggcttcccccagctaattttttatattttagtagagacaaggtttcgccatgttggccaggctggtcttgaactcctgacctcaggtgatccgtctgctttggcctcccaaagtgctgggattagaagcgtgagccaccacgcccagcctttttttgtatttttagtagagatggggtttcgccatgttggccaggctggtctcaaactcctgacctcaggtgatctgcccacctcagcctcccaaagtgctaggattacaggataagccactgcacctggccagctctagtcttattttgctgaaaaagggaggcaattgagggaaaggcctgctggcctgggacactggagacgtgggtttaccacacagccttgggaaatttatctaactctctgggcccctttgtacttttcagcttagagatttgggggttaaagtagatcagtaatttccaaactcttcacagagtaccagggtctgtagagatgcctcacaggcctccatgacaggccaagaagatggcctatgatctctgaaaccagcccccacttcaatcagatcaaagtaattccattctgttttatatgctgggattctgcttaagatttcatttgataaaaagaatcttctgctt

SEQ ID NO: 148277 - DNA, 671 bp, Homo sapiens
  Payload ID: 9355
  Gene Symbol: LEUTX
  Gene Name: leucine twenty homeobox
  Uniprot ID: A8MZ59
  ENST ID: ENST00000396841
  CDS Start-End: 165-671
ctgcacacggttttcagcctcatgcctccgtggaacctgcctgtcaggcgggcacctggaatctcaagcaactttctcaagaagggccaaggcgttatcgtcggccacgcacaagatttctctccaaacaactcacagcattgagagaattgcttgaaaagaccatgcacccaagtttggctacaatggggaaactggcttcaaagctacaacttgatctatccgtagtaaagatctggttcaagaaccagcgtgccaaatggaagaggcagcagcggcagcaaatgcagacacggccatcactagggccagcaaaccagacaacttcagtgaagaaggaggagactccctcagccataactactgcaaacattcgtccagtaagtcctggaatctctgatgcaaatgaccatgatctacgtgagccttctggtatcaagaatcctggaggagccagcgcctctgcgagggtttcatcctgggattctcagtcatatgacattgaacagatatgtctgggggcttcaaatcctccttgggcctccactctctttgaaatagatgaatttgtaaagatctatgacttgccaggggaagatgacaccagcagcctaaatcaatatctttttccagtatgccttgagtatgaccagctccaatcttcagtgtaa

SEQ ID NO: 148278 - DNA, 671 bp, Homo sapiens; identical to SEQ ID NO: 148277
  Payload ID: 9355
  Gene Symbol: LEUTX
  Gene Name: leucine twenty homeobox
  Uniprot ID: A8MZ59
  ENST ID: ENST00000629267
  CDS Start-End: 165-671

SEQ ID NO: 148279 - DNA, 945 bp, Homo sapiens
  Payload ID: 9356
  Gene Symbol: LZIC
  Gene Name: leucine zipper and CTNNBIP1 domain containing
  Uniprot ID: Q8WZA0
  ENST ID: ENST00000377213
  CDS Start-End: 227-799
agtgcgtgcgtccagcggaagtgctcccccggcgcggtccgccaggccagtgccctcagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatgg

SEQ ID NO: 148280 - DNA, 2281 bp, Homo sapiens
  Payload ID: 9356
  Gene Symbol: LZIC
  Gene Name: leucine zipper and CTNNBIP1 domain containing
  Uniprot ID: Q8WZA0
  ENST ID: ENST00000377223
  CDS Start-End: 249-821
ctaaactctgggactggcgggcggtcaggcggcacagggggaatcccgggggcctaaggaggttgtcccagtttttgtcagcatctccaccccgaggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatggcttgtgtttatgctcttcatcattgtgcgttgtgtgcggttacctgcttgagtgatcctgaacttgttgcgacagagggactcactggactctgttcgttatgatttgtctgtttaagagagaaaacaaagtggacttgatttttattaaggctgtttgtttttaagtgttgatagtgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggaaactgaggtccagaaagagcaagcgactttgcttaaagtcgcatcagagagctgagggtaagactcaggtgtcctgactcccagtttagtatcttttgaattttatttctgtaccatttaaaaaaaataattaacactatttgtgcaagtcagtgtttttgaaaattcagtgtcccaataaaaagtggactgcacactaagggaccatcccccagcctgtaagctgtctgtattaatggggcccgttgtatctcggaattttgaggttggaacaatgggagccctgttgagcgtttcctaaagtgacttagccgcctgcgttgtttgaccagggaagcaacaggaaatggcagctagaggccctccctgtgcgtgacctcttgtcacactcagaggggggtaactgtcagctgttatctactcttcaggttttggagaaacacaaaataagttatgaggaaaagcaaatttctctcctgagtatttacatgtctctgtatgctcaaatatgcagatgtgtccctatgcgtgtatattagcttattttttaggctctagccattttatattctttcatgtgcttctcaatattctttttctttgcactttatacaaattaaaagcatttttaaagcttcttctgtactgtaaactactaggtgctttgccaaccagacagattagaggacctccgctacactgatgccttatttggaacttaaaagaggtgaaattcatatatcataaaattcaccattttaaagtgtaccattcgttggcagaacatttacagtggtgtgcaaccatcactactctctagttgcagaacattcttatcacccccaaaggaggccctatacctattaagcagttagtccccattcccttctcctccgactgctaacaatagccactaatctgcaccctgtctctgtggatttacctattctggatatttcatataaatggaatcatatga

SEQ ID NO: 148281 - DNA, 1405 bp, Homo sapiens
  Payload ID: 9356
  Gene Symbol: LZIC
  Gene Name: leucine zipper and CTNNBIP1 domain containing
  Uniprot ID: Q8WZA0
  ENST ID: ENST00000400903
  CDS Start-End: 154-726
ggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacagagacaagcaaattaaagcagaatttagaagaacagttggatagactcatgcaacaattacaagatctggaggaatgcagagaggaacttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggctctggagacaaaattcttgctctggcaagttttgaggttgaaaaaacaaaaaaatgacatggtgcagaagcttgtaacattgatcacattcttaatgtaaatggtgtctttcttctggggttttcagttattgcaaagaaatgaagagattctggaaatgcatcaataacctaagaaaaagcgacataaaaatatacttatggcttgtgtttatgctcttcatcattgtgcgttgtgtgcggttacctgcttgagtgatcctgaacttgttgcgacagagggactcactggactctgttcgttatgatttgtctgtttaagagagaaaacaaagtggacttgatttttattaaggctgtttgtttttaagtgttgatagtgaacgaaaagatgtgaagtaatgatatttttctgcttacaacttatccccactcattggagtgaacagtgacgcaagctcaatagacttcataagtgttcatagaattttacaattctgagtgatcttagaaatcatttctgtttttacaaacaaggaaactgaggtccagaaagagcaagcgactttgcttaaagtcgcatcagagagctgagggtaagactcaggtgtcctgactcccagtttagtatcttttgaattttatttctgtaccatttaaaaaaaataattaacactatttgtgcaagtcagtgtttttgaaaattcagtgtcccaataaaaagtggactgcacact

SEQ ID NO: 148282 - DNA, 652 bp, Homo sapiens
  Payload ID: 9356
  Gene Symbol: LZIC
  Gene Name: leucine zipper and CTNNBIP1 domain containing
  ENST ID: ENST00000488540
  CDS Start-End: 1-510
cttgatacagatgaatatgaagaaaccaaaaaggaaactctggagcaactaagtgaatttaatgattcactaaagaaaattatgtctggaaatatgactttggtagatgaactaagtggaatgcagctggctattcaggcagctatcagccaggcctttaaaaccccagaggtcatcagattgtttgcaaagaaacaaccaggtcagcttcggacaaggttagcagagatggatagagatctgatggtaggaaagctggaaagagacctgtacactcaacagaaagtggagatactaacagctcttaggaaacttggagagaagctgactgcagatgatgaggccttcttgtcagcaaatgcaggtgctatactcagccagtttgagaaagtctctacagaccttggacggcccccaagttacatgaactacctgctagactcacaccccagcaaaaatattgatgtccccagcaagattagcttcctgttaaagatccaggacctgtgaatacatgcgtaactgcaagaatggaagcaaaggatgaacccaagttaaagcccagcacaagaatatgatgtaagcgcttttgggaaatgcagagattttcttttctcttcaaataataaattacatctaaaaattaatgaga

SEQ ID NO: 148283 - DNA, 8898 bp, Homo sapiens
  Payload ID: 9357
  Gene Symbol: LUZP1
  Gene Name: leucine zipper protein 1
  Uniprot ID: Q86V48
  ENST ID: ENST00000302291
  CDS Start-End: 803-4033
gagagcgcgcccggcaccggcggcttcccaggcccgcggccggctggcggcgcggagctgtcactgcggcaaacggcgaacgcgccggccccctcccccgccgcccgcaagcctggtgcagtcggcccatgagtatttcatgaagtgccgcagccggattcatggctcactggcgcaggaggggagagaggctgagtcctgtcaagcgccagcgccccacccgtcacggagcgcacgccgcgggggccaggctggggagggaagggtgtccagccctctcttttgggtggtgagatgctgaggcctgagggtttctagggcgcctagcacaggacccagctacggaggcaataaaaacttggtggagtctaagtcctgggaagggaaaaaaaggacggagggggcggggcctacagacaaccccgcccatcacaaagaccccgccttccagaacgctgacgtcacaatttggccccgcccctcattgtcagtcccgcggagccagaggaggcgccggtcgctggcagctgagcggcggaacccttcgctggcgggagcgcggttcggggccgcagaggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagagaatgaaacaagaaacaaatcagaaaatgaaaagaaccgcaatcaggaagacaacaaagtcaaagaccttaaccaagagattgagaaacttaagacacaaatcaaacactttgaatcgttggaagaagagcttaagaaaatgaagtccaaaaataacgaccttcaggataattacctaagtgaacaaaataaaaacaaattattagccagccaactggaggagataaagctacaaatcaagaaacagaaagagttagaaaatggagaggtagaaggggaagatgctttcctgtccagcaaaggcagacatgagaggactaagtttagaggccacggaagtgaagcttctgtgtccaagcacacagcgcgggaactgtctcctcagcataagcgggaacgactccggaacagggagtttgctctcaacaatgaaaactattctctgagcaacaggcaggtttcttctcccagtttcaccaacaggagggcagcaaaagcttctcacatgggggtgagtacagacagtgggactcaggagacaaagaaaactgaagaccggtttgtacccggctcctcccagagcgaagggaagaagtctagggagcagccctcagtgctgagtcgctaccccccggctgctcaggagcacagtaaagcgtggaaggggacttccaagccaggcaccgagagcggactgaagggaaaagtggagaagacaacacgaacgtttagtgacaccacccatggatctgttcccagtgacccattgggtagagctgacaaggcttctgacacctcctctgagactgtctttggcaagaggggacacgtgcttggcaacggaagtcaagtaactcaggctgcaaactctggctgttctaaggccattggagccctggcctcatctcgaagatcctcctcagaagggctctctaaaggcaaaaaggctgccaatggccttgaggctgataacagttgcccgaattccaaggctcctgttctatcgaagtatccttatagctgtagaagccaagagaacatccttcagggattttcaacctcacataaagaaggggttaatcaacctgcagcagttgtgatggaagacagcagtccgcatgaagccttgaggtgtcgagtcatcaaatccagtggcagagagaagccagactcagatgatgacttggacatagcatctcttgttactgccaagttggtaaatacaaccatcactccagagccagagcccaaaccacagcctaactctagagaaaaggctaaaacccgaggggcacctagaacctccctatttgagaatgataaagatgctggaatggagaatgaatctgtgaaatctgtcagagcctccaccaataccatggagctcccagataccaatggtgctggggtaaaaagccaaaggccctttagccccagagaggcgttgcggtctagagccatcatcaaacctgttattgttgataaggatgtgaaaaaaatcatgggaggatctggaacagagactacgttggagaaacagaaacccgtctccaaaccagggccaaacaaagtgacaagtagcattactatatatccatctgacagcagcagccccagagctgctccgggtgaggccctgagggagaggcacacatccactagcaatatccaggtggggctggcagagctcacatcagttagcaaccatgtcagctccccttttgagctctccattcacaaacatgacatcaccctgcagcttgcagaagcggagagaatggcagatgggcccctgaaggacaggccagaaacagtggtctctcggagcagcattataatcaagccatcggatcctgtggagaggaatagccatgcacctccagcggagacaatcaggtggaaaagccatagtgccccttcagaagtgggcttctcagatgccagacatgttactgtgcggaatgcctggaagagtaggcgagacttgaaatctttagaagaccccccaactcgaataggtaaaaacgtggaatctaccaatagcaatgcctacacccagaggtcttccacagacttctcagaactcgaacagcccaggtcctgcctttttgagcagggcactcgaagggtaggaccaagttcaggggatgcccctgagccctcctccagaaggacccaaagtagcctcactgtgtcagaggtgcttacccgtcggaatcgggtaggagacaccatcactgtcgcagcctggaaccactcagcaagcatggaggaagaaggggaagactgtacactcagtgtctacaggcaactgcacaactccctggatccgtctgaactgcctgggaagcaggggctgccagagtctgggcgagtacgggccgaggaacgattacggccaaccaggccctgtgctgaggagaactgagcccgctgggtgtctgttgtctgccctctgctcctgcttctcagctcttccaccgtcctgccccacgaaggatccaaggccagttaaccaggcaagacacaagccttggctggaaaactgtggtagagccgggctgtggctcaggtaatttttgccatttggccagagggaatcagagactacaagctggacagtcacccaggcccaaccttccccaatgcacgagtcctctctctctccttgtccctgtccaccaagtagttggaccattctggcccccaaacaagggaagataaagtccccagcacacagcaggagtcaaaaattcttctcggctccttggtgggttgtttctggatcctagggcagcctctgtctgtgtggttaatgttctggtttctcagtctcctcactatatccacttcactcctcatttgcccaatgggctcaagtaccccataagatttaccagccatcagctctatctagggggctttcatttctttccccttggagttcttttcttcagacttaaagcagaaaggggtctgtgctgcctctaaaggattatgagactaccctttaggttgaagtttgacctggctcctggcttaccagtctcctggaagcagagcatgcagatactcatgcggatacccattggaatgacatcatccctccccaaccccagctctctctgctcaccttccaaaggcacctggaggtgcaagcctcatgcatctcctttcctgagcaccagtaatgctgctggcatcgcctgctttctctccagtggctggagacttcaagctgacttcattgtttccaccttgggaaaatccctaggctaagctgggcctgacccagcatcctctgccttctaggaagtgcccagcaagagggaaagcagacccctttagtcactccacaagcaatagctccatgagaggcatggactgtgagactactccctcctgttcctccttctccatcccccatggaggaggcatcgcactttaccaagctgatgcattcctacagaagtgggccccggatttctgcaagtcgactatcatgatgacttcgctggaggaaaggtgatacgtacatacgcattgagggcctcagctttatatagttcaaaatgcagcaaacttttcagaaagccacgtaaataaattggttaggttccttataccagtcacatggggaagttgaaaagaattgtatattcttggcagtgctttttctttagcattctgtcaattcaaagaagggatcctctttcaaaggctacctttatgaagtagacactattgccctcagaatgagagaacattaaactaccagtctggtaagctggatttttttccccatggctttacttccttgctgtgtgaccttgggtgagtcattgtcttcttggagcctcagtttccctgtctgtaaaatgagttctttgaaatggatgatctctaagggcaccaaatctggtattctaaggttctcctgttttcaccatctataatagtatgggatgatttttgcttgtggaaggtatcatccgtgtgggttcttccctcctgccctcaattgtttttctgggccttgttttttagtttctgtatgttttaatctcatggggatgagctcagagaagctccgtgggcctgtttcccaatctgcaaagtgtgaagggattagatgggatggtctctgaggctctttgtggcatcagccttgcccagtgccacacagtatctcctggcgttctaggagtctaggtattatggaaagtacccaagtctgtgtatctcctgttcctgtgcatctcctatgaatttcctggcaagaggaagactcaagacttcctccagaggaatttgtcttctctgccttcactcagcatgggaaccagtgttcatcctgaccttgtctgtatcagatttggcagtgaggaggcttggggagcacctaccttactttcagggacaggaatctattgctcatacttctgcttcccagagttttgccaatctaaaggcattgtcatgtggcctgcctttcctgtccacatccccacctctgatgctcaagatgctatttccaagatctcttactgctgcttctcctggcttactggccagaaactagctcactcaaggctgccatccttcacttgcagcctccctgccattctccttcactggttggcaaccttgagagttcaaagaaaatcaacctctgtggtggtcaactaaaggtattaggaaactaagtctgtggctcttctctgctgatggaaacagaagggcgccaagccatgcctaaaaagatctcgccaataattcttgtctttgagtgttggagccctggattctggtgctatagctcctggtgccaaagtctggatctttccacatttcagcagcaccaacatctgctgctactcaaaatgtcctgttgaagagggacagctgtgatgcccttttgctggggctgccatcttgaaatctgagtgcaataggatttgcttgtaacagttatttcaggatattttgtttctttaatctgcacactttctagatagattttatttttaagtgtcctcagcattgcagaaaataacattgtaatagcaagtaaaggctggaggctgtttctctgggcttcaaatggctggcaaggctggctctcaaatcccaaagttgggaggcatgtttctgaaaagcaactgaggtgtgactgtttggacccaggcctcatcatcaggggtcctggaggaagcctccaagtagaggggagacctggtagttgaatagttgtttaatcaagccaaatagtcccactgcccccggtcaacaaacccacttttatgacagttttcttccgcagcttggctcttaaattttactggcaggtgtatggttgttggagggttcctagtgagttgggggacctggcaatagagctgcttggttggaggaagtgaagctggcttagtaccagcagctgatctcttccacgtgctgctgctttttttgccactctgatactaaaccagagaaagctgcaggtggataaagaagctgtggctgttttttgcttttgggtggcaatgagaaagagtcacagtgtgggttaaagggatctgcagtggggccaaggatgccaccccaccctcagctgtaggcaagcttgcacataaataacccccgtcagtggagtgttcgggatgcagggggcactatagtgttcttggacttgtcgtcctggggcagttttagttctttatatttagtgggtcagtgccaagtgctaccacttcccaataaaggaatggggacccagaggctgggtccctggctaccttgttatgaggttttgttatttctctgacaagattgctttggaaagagctgcttttagggattattttttgaataccccgagtggggagcagggttctcctcaaagcctcacaaccataggatcataggaaaggggccctattttcctgctgcttcccagctcagaacatatactgaatggaatgtatttttaagagaataaagtctatttttttgtattttaaagattgagagggctaagaaagtagccctcaaataaactgttattgcattataggcccctttgttgggggcagcctgttggtccacacctacttgctcaggcaggtgctctggtctctctcacccctgccccttagagtctaggtgcagcagctccaagcatgggaccaaggaggccagaacctgtcgctggaaaccagggcaaagcagtggctcagggctccttgggtgcatgtgtatcattggagctgcctgtctgcatgtatcctctggcgcgaatgctctctgttggctctgcagtacaatatgtaaccaataaagctccctcgtttccgtatactctgtgcgagtctgtgatgccagttttgtcaatgtcatccctgtgtatcatctgtcttctatgcgttggcgcagctctagtatatttatttatttcattgtgtaatacttaaaattgggtattttacctaaccaattactgatactgcaaggactggaaacattaactgccctgatcctggtgtgcagattctttccattactgccacgaattctaagactagggggggaaaagccttctccgttttcatcttccagtcagatcaccaatatatataatgatgtcccttaactcacagtaagaaagaataaaaccacatttaagggacattacttggatttgcagtaacagtgtttatcatctatctgtcagtcagtcaggagcccctgggaaggaaccagcatgtaacatgtttttatcatcttatatggcaaaagggactttgcagataaggatgctgggatgaggcagaacatcctagatgatccaggtgggccttaaatgtaatcacaggtagtatccttttaagagagagacaaaagatttgactacaggagaaggcaatgtgatgatggaagcagaaactggagttatgtgctctgaggatggaggaaggagccacgagccttcccacacctagaagctgaaaagagcaaggaaatgaactgatcctccctgctctgagagcctctgtaatgaatgcagccctgtgtacccattttagactttaagcttccagaactttcgaatagatttctgtttttttaagagccactaagtttgtggcaatctgttaaaccagctgttacctaagcccttgatcctatgtagtgcgcttcccaaaatgtacaccaccacctttagtagaattgggaagttttagcacatacccatggagggaatcaggaataaaggcagactggtctcccaaa

SEQ ID NO: 148284 - DNA, 3715 bp, Homo sapiens
  Payload ID: 9357
  Gene Symbol: LUZP1
  Gene Name: leucine zipper protein 1
  Uniprot ID: Q86V48
  ENST ID: ENST00000314174
  CDS Start-End: 172-3252
agctgagcggcggaacccttcgctggcgggagcgcggttcggggccgcagagattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagagaatgaaacaagaaacaaatcagaaaatgaaaagaaccgcaatcaggaagacaacaaagtcaaagaccttaaccaagagattgagaaacttaagacacaaatcaaacactttgaatcgttggaagaagagcttaagaaaatgaagtccaaaaataacgaccttcaggataattacctaagtgaacaaaataaaaacaaattattagccagccaactggaggagataaagctacaaatcaagaaacagaaagagttagaaaatggagaggtagaaggggaagatgctttcctgtccagcaaaggcagacatgagaggactaagtttagaggccacggaagtgaagcttctgtgtccaagcacacagcgcgggaactgtctcctcagcataagcgggaacgactccggaacagggagtttgctctcaacaatgaaaactattctctgagcaacaggcaggtttcttctcccagtttcaccaacaggagggcagcaaaagcttctcacatgggggtgagtacagacagtgggactcaggagacaaagaaaactgaagaccggtttgtacccggctcctcccagagcgaagggaagaagtctagggagcagccctcagtgctgagtcgctaccccccggctgctcaggagcacagtaaagcgtggaaggggacttccaagccaggcaccgagagcggactgaagggaaaagtggagaagacaacacgaacgtttagtgacaccacccatggatctgttcccagtgacccattgggtagagctgacaaggcttctgacacctcctctgagactgtctttggcaagaggggacacgtgcttggcaacggaagtcaagtaactcaggctgcaaactctggctgttctaaggccattggagccctggcctcatctcgaagatcctcctcagaagggctctctaaaggcaaaaaggctgccaatggccttgaggctgataacagttgcccgaattccaaggctcctgttctatcgaagtatccttatagctgtagaagccaagagaacatccttcagggattttcaacctcacataaagaaggggttaatcaacctgcagcagttgtgatggaagacagcagtccgcatgaagccttgaggtgtcgagtcatcaaatccagtggcagagagaagccagactcagatgatgacttggacatagcatctcttgttactgccaagttggtaaatacaaccatcactccagagccagagcccaaaccacagcctaactctagagaaaaggctaaaacccgaggggcacctagaacctccctatttgagaatgataaagatgctggaatggagaatgaatctgtgaaatctgtcagagcctccaccaataccatggagctcccagataccaatggtgctggggtaaaaagccaaaggccctttagccccagagaggcgttgcggtctagagccatcatcaaacctgttattgttgataaggatgtgaaaaaaatcatgggaggatctggaacagagactacgttggagaaacagaaacccgtctccaaaccagggccaaacaaagtgacaagtagcattactatatatccatctgacagcagcagccccagagctgctccgggtgaggccctgagggagaggcacacatccactagcaatatccaggtggggctggcagagctcacatcagttagcaaccatgtcagctccccttttgagctctccattcacaaacatgacatcaccctgcagcttgcagaagcggagagaatggcagatgggcccctgaaggacaggccagaaacagtggtctctcggagcagcattataatcaagccatcggatcctgtggagaggaatagccatgcacctccagcggagacaatcaggtggaaaagccatagtgccccttcagaagtgggcttctcagatgccagacatgttactgtgcggaatgcctggaagagtaggcgagacttgaaatctttagaagaccccccaactcgaataggtaaaaacgtggaatctaccaatagcaatgcctacacccagaggtcttccacagacttctcagaactcgaacagcccaggtcctgcctttttgagcagggcactcgaagggtaggaccaagttcaggggatgcccctgagccctcctccagaaggacccaaagtagcctcactgtgtcagaggtgcttacccgtcggaatcgggtaggagacaccatcactgtcgcagcctggaaccactcagcaagcatgagcagctaaaggagctccccgtaggccctcagaacagcatgaaaagcacaagaagcagctgcagctgatggggagctctgggcaacaggaggaggcccggtgccctttctgtagggcacagtgagggggagccaggtcagcaagttctcggccgcctcagttagcagatcttcacaggctgctggcctctcagggatgaggagagccggggcttacactgggcctattttagataagcgtatacccaattccaagtgacactttcttttgccccccagacagctgtctgtctcatattatcagtctgagggcagggctggttcagtatagctcattacagctttgataaatccagaaccacctgccttatgtgagtgtgaggctcagggtgtcagaacagcatctggagaagcccctgggagtgtctttttgatgagaaacctgtgatgatgaaaaacttcttggacctgga

SEQ ID NO: 148285 - DNA, 8421 bp, Homo sapiens
  Payload ID: 9357
  Gene Symbol: LUZP1
  Gene Name: leucine zipper protein 1
  Uniprot ID: Q86V48
  ENST ID: ENST00000418342
  CDS Start-End: 319-3549
ttgtcagtcccgcggagccagaggaggcgccggtcgctggcagctgagcggcggaacccttcgctggcgggagcgcggttcggggccgcagaggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagagaatgaaacaagaaacaaatcagaaaatgaaaagaaccgcaatcaggaagacaacaaagtcaaagaccttaaccaagagattgagaaacttaagacacaaatcaaacactttgaatcgttggaagaagagcttaagaaaatgaagtccaaaaataacgaccttcaggataattacctaagtgaacaaaataaaaacaaattattagccagccaactggaggagataaagctacaaatcaagaaacagaaagagttagaaaatggagaggtagaaggggaagatgctttcctgtccagcaaaggcagacatgagaggactaagtttagaggccacggaagtgaagcttctgtgtccaagcacacagcgcgggaactgtctcctcagcataagcgggaacgactccggaacagggagtttgctctcaacaatgaaaactattctctgagcaacaggcaggtttcttctcccagtttcaccaacaggagggcagcaaaagcttctcacatgggggtgagtacagacagtgggactcaggagacaaagaaaactgaagaccggtttgtacccggctcctcccagagcgaagggaagaagtctagggagcagccctcagtgctgagtcgctaccccccggctgctcaggagcacagtaaagcgtggaaggggacttccaagccaggcaccgagagcggactgaagggaaaagtggagaagacaacacgaacgtttagtgacaccacccatggatctgttcccagtgacccattgggtagagctgacaaggcttctgacacctcctctgagactgtctttggcaagaggggacacgtgcttggcaacggaagtcaagtaactcaggctgcaaactctggctgttctaaggccattggagccctggcctcatctcgaagatcctcctcagaagggctctctaaaggcaaaaaggctgccaatggccttgaggctgataacagttgcccgaattccaaggctcctgttctatcgaagtatccttatagctgtagaagccaagagaacatccttcagggattttcaacctcacataaagaaggggttaatcaacctgcagcagttgtgatggaagacagcagtccgcatgaagccttgaggtgtcgagtcatcaaatccagtggcagagagaagccagactcagatgatgacttggacatagcatctcttgttactgccaagttggtaaatacaaccatcactccagagccagagcccaaaccacagcctaactctagagaaaaggctaaaacccgaggggcacctagaacctccctatttgagaatgataaagatgctggaatggagaatgaatctgtgaaatctgtcagagcctccaccaataccatggagctcccagataccaatggtgctggggtaaaaagccaaaggccctttagccccagagaggcgttgcggtctagagccatcatcaaacctgttattgttgataaggatgtgaaaaaaatcatgggaggatctggaacagagactacgttggagaaacagaaacccgtctccaaaccagggccaaacaaagtgacaagtagcattactatatatccatctgacagcagcagccccagagctgctccgggtgaggccctgagggagaggcacacatccactagcaatatccaggtggggctggcagagctcacatcagttagcaaccatgtcagctccccttttgagctctccattcacaaacatgacatcaccctgcagcttgcagaagcggagagaatggcagatgggcccctgaaggacaggccagaaacagtggtctctcggagcagcattataatcaagccatcggatcctgtggagaggaatagccatgcacctccagcggagacaatcaggtggaaaagccatagtgccccttcagaagtgggcttctcagatgccagacatgttactgtgcggaatgcctggaagagtaggcgagacttgaaatctttagaagaccccccaactcgaataggtaaaaacgtggaatctaccaatagcaatgcctacacccagaggtcttccacagacttctcagaactcgaacagcccaggtcctgcctttttgagcagggcactcgaagggtaggaccaagttcaggggatgcccctgagccctcctccagaaggacccaaagtagcctcactgtgtcagaggtgcttacccgtcggaatcgggtaggagacaccatcactgtcgcagcctggaaccactcagcaagcatggaggaagaaggggaagactgtacactcagtgtctacaggcaactgcacaactccctggatccgtctgaactgcctgggaagcaggggctgccagagtctgggcgagtacgggccgaggaacgattacggccaaccaggccctgtgctgaggagaactgagcccgctgggtgtctgttgtctgccctctgctcctgcttctcagctcttccaccgtcctgccccacgaaggatccaaggccagttaaccaggcaagacacaagccttggctggaaaactgtggtagagccgggctgtggctcaggtaatttttgccatttggccagagggaatcagagactacaagctggacagtcacccaggcccaaccttccccaatgcacgagtcctctctctctccttgtccctgtccaccaagtagttggaccattctggcccccaaacaagggaagataaagtccccagcacacagcaggagtcaaaaattcttctcggctccttggtgggttgtttctggatcctagggcagcctctgtctgtgtggttaatgttctggtttctcagtctcctcactatatccacttcactcctcatttgcccaatgggctcaagtaccccataagatttaccagccatcagctctatctagggggctttcatttctttccccttggagttcttttcttcagacttaaagcagaaaggggtctgtgctgcctctaaaggattatgagactaccctttaggttgaagtttgacctggctcctggcttaccagtctcctggaagcagagcatgcagatactcatgcggatacccattggaatgacatcatccctccccaaccccagctctctctgctcaccttccaaaggcacctggaggtgcaagcctcatgcatctcctttcctgagcaccagtaatgctgctggcatcgcctgctttctctccagtggctggagacttcaagctgacttcattgtttccaccttgggaaaatccctaggctaagctgggcctgacccagcatcctctgccttctaggaagtgcccagcaagagggaaagcagacccctttagtcactccacaagcaatagctccatgagaggcatggactgtgagactactccctcctgttcctccttctccatcccccatggaggaggcatcgcactttaccaagctgatgcattcctacagaagtgggccccggatttctgcaagtcgactatcatgatgacttcgctggaggaaaggtgatacgtacatacgcattgagggcctcagctttatatagttcaaaatgcagcaaacttttcagaaagccacgtaaataaattggttaggttccttataccagtcacatggggaagttgaaaagaattgtatattcttggcagtgctttttctttagcattctgtcaattcaaagaagggatcctctttcaaaggctacctttatgaagtagacactattgccctcagaatgagagaacattaaactaccagtctggtaagctggatttttttccccatggctttacttccttgctgtgtgaccttgggtgagtcattgtcttcttggagcctcagtttccctgtctgtaaaatgagttctttgaaatggatgatctctaagggcaccaaatctggtattctaaggttctcctgttttcaccatctataatagtatgggatgatttttgcttgtggaaggtatcatccgtgtgggttcttccctcctgccctcaattgtttttctgggccttgttttttagtttctgtatgttttaatctcatggggatgagctcagagaagctccgtgggcctgtttcccaatctgcaaagtgtgaagggattagatgggatggtctctgaggctctttgtggcatcagccttgcccagtgccacacagtatctcctggcgttctaggagtctaggtattatggaaagtacccaagtctgtgtatctcctgttcctgtgcatctcctatgaatttcctggcaagaggaagactcaagacttcctccagaggaatttgtcttctctgccttcactcagcatgggaaccagtgttcatcctgaccttgtctgtatcagatttggcagtgaggaggcttggggagcacctaccttactttcagggacaggaatctattgctcatacttctgcttcccagagttttgccaatctaaaggcattgtcatgtggcctgcctttcctgtccacatccccacctctgatgctcaagatgctatttccaagatctcttactgctgcttctcctggcttactggccagaaactagctcactcaaggctgccatccttcacttgcagcctccctgccattctccttcactggttggcaaccttgagagttcaaagaaaatcaacctctgtggtggtcaactaaaggtattaggaaactaagtctgtggctcttctctgctgatggaaacagaagggcgccaagccatgcctaaaaagatctcgccaataattcttgtctttgagtgttggagccctggattctggtgctatagctcctggtgccaaagtctggatctttccacatttcagcagcaccaacatctgctgctactcaaaatgtcctgttgaagagggacagctgtgatgcccttttgctggggctgccatcttgaaatctgagtgcaataggatttgcttgtaacagttatttcaggatattttgtttctttaatctgcacactttctagatagattttatttttaagtgtcctcagcattgcagaaaataacattgtaatagcaagtaaaggctggaggctgtttctctgggcttcaaatggctggcaaggctggctctcaaatcccaaagttgggaggcatgtttctgaaaagcaactgaggtgtgactgtttggacccaggcctcatcatcaggggtcctggaggaagcctccaagtagaggggagacctggtagttgaatagttgtttaatcaagccaaatagtcccactgcccccggtcaacaaacccacttttatgacagttttcttccgcagcttggctcttaaattttactggcaggtgtatggttgttggagggttcctagtgagttgggggacctggcaatagagctgcttggttggaggaagtgaagctggcttagtaccagcagctgatctcttccacgtgctgctgctttttttgccactctgatactaaaccagagaaagctgcaggtggataaagaagctgtggctgttttttgcttttgggtggcaatgagaaagagtcacagtgtgggttaaagggatctgcagtggggccaaggatgccaccccaccctcagctgtaggcaagcttgcacataaataacccccgtcagtggagtgttcgggatgcagggggcactatagtgttcttggacttgtcgtcctggggcagttttagttctttatatttagtgggtcagtgccaagtgctaccacttcccaataaaggaatggggacccagaggctgggtccctggctaccttgttatgaggttttgttatttctctgacaagattgctttggaaagagctgcttttagggattattttttgaataccccgagtggggagcagggttctcctcaaagcctcacaaccataggatcataggaaaggggccctattttcctgctgcttcccagctcagaacatatactgaatggaatgtatttttaagagaataaagtctatttttttgtattttaaagattgagagggctaagaaagtagccctcaaataaactgttattgcattataggcccctttgttgggggcagcctgttggtccacacctacttgctcaggcaggtgctctggtctctctcacccctgccccttagagtctaggtgcagcagctccaagcatgggaccaaggaggccagaacctgtcgctggaaaccagggcaaagcagtggctcagggctccttgggtgcatgtgtatcattggagctgcctgtctgcatgtatcctctggcgcgaatgctctctgttggctctgcagtacaatatgtaaccaataaagctccctcgtttccgtatactctgtgcgagtctgtgatgccagttttgtcaatgtcatccctgtgtatcatctgtcttctatgcgttggcgcagctctagtatatttatttatttcattgtgtaatacttaaaattgggtattttacctaaccaattactgatactgcaaggactggaaacattaactgccctgatcctggtgtgcagattctttccattactgccacgaattctaagactagggggggaaaagccttctccgttttcatcttccagtcagatcaccaatatatataatgatgtcccttaactcacagtaagaaagaataaaaccacatttaagggacattacttggatttgcagtaacagtgtttatcatctatctgtcagtcagtcaggagcccctgggaaggaaccagcatgtaacatgtttttatcatcttatatggcaaaagggactttgcagataaggatgctgggatgaggcagaacatcctagatgatccaggtgggccttaaatgtaatcacaggtagtatccttttaagagagagacaaaagatttgactacaggagaaggcaatgtgatgatggaagcagaaactggagttatgtgctctgaggatggaggaaggagccacgagccttcccacacctagaagctgaaaagagcaaggaaatgaactgatcctccctgctctgagagcctctgtaatgaatgcagccctgtgtacccattttagactttaagcttccagaactttcgaatagatttctgtttttttaagagccactaagtttgtggcaatctgttaaaccagctgttacctaagcccttgatcctatgtagtgcgcttcccaaaatgtacaccaccacctttagtagaattgggaagttttagcacatacccatggagggaatcaggaataaaggcagactggtctcccaaaggctcag

SEQ ID NO: 148286 - DNA, 1190 bp, Homo sapiens
  Payload ID: 9357
  Gene Symbol: LUZP1
  Gene Name: leucine zipper protein 1
  ENST ID: ENST00000471849
  CDS Start-End: 372-1190
ggagccagaggaggcgccggtcgctggcagctgagcggcggaacccttcgctggcgggagcgcggttcggggccgcagaggggacattgaataaacctgagtattgtgtgcctgtattttgactgcgacctatcagatgagatcaggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaacctccagaaagcagaggatgaactcctggatctccaggacaaggtgattcaggcagaaggtagcaactccagcatgttggcggagattgaagtgctgcgccagcgggtgctgagaattgaaggcaaagacgaggaaattaagagagcagaggatctgtgtcgtctgatgaaggagaaacttgaagaggaagaaaacctcacccgggagctgaaatctgagattgagcggcttcagaaacgaatggctgaattagagaagctagaagaggccttcagcaggagtaagaatgactgtacccagctgtgtctgagcctgaatgaggagagaaatctgaccaagaaaatctcctctgagctggaaatgctcagagtcaaagtgaaagaactagaatcttctgaggaccgcctggataaaactgagcagagtttagcgtcagagttagaaaagctgaaatcattaactctgagctttgtaagtgagagaaaatacttgaatgaaaaggagaaagaaaatgagaaattgataaaagaactcactcaaaaactagagcagaacaaaaaaatgaaccgagattatacaaggaatgcttctaatctggaaagaaatgacctacggattgaggatggcatctcttccacactgccgtccaaagaatcaagaaggaagggtggtctggactacctaaagcaggtagagaatgaaacaagaaac

SEQ ID NO: 148287 - DNA, 613 bp, Homo sapiens
  Payload ID: 9357
  Gene Symbol: LUZP1
  Gene Name: leucine zipper protein 1
  ENST ID: ENST00000475164
  CDS Start-End: 507-613
gtgatcctcccgcctcagcctcccaagaagctgggatgacaagtgtgtgccaccatgcctggctaatttttgtatttttagtagaaacagggtttcaccattttggccaggctgttctcaaactcctgacttcaagtcatccactcgcctcggccttccagagtgctgggattacaggcatgagccactgcgcccagtctgtctcattgttgatggggacattgaataaacctgagtattgtgtgcctgtattttgactgcgacctatcagatgagatcaggtcaagagacaactgcctttgaaagagagtgagtgactgtttccaaaacagcaagcatagggagagccgccggaagtattgacggaaagcttgaattacctacatgattgatgatggtctccagctgtcaaagaagattgtggttgccaagagaaaggtaaccatttctcatccccttgagtggaattggatgcctctaggagcccacattggctggcagtagacatggccgaatttacaagctacaaggagacggcctccagccgccacttgcggtttaagctacagagtctaagccgccgccttgatgagttggaggaagccacaaaaaa

SEQ ID NO: 148288 - DNA, 3553 bp, Homo sapiens
  Payload ID: 9358
  Gene Symbol: LUZP2
  Gene Name: leucine zipper protein 2
  Uniprot ID: Q86TE4
  ENST ID: ENST00000336930
  CDS Start-End: 67-1107
agcgacaggatcccgaagagagagagagaaggcagcgagggaaggaggaccccggcaggcagcagcatgaaattcagcccagcgcactacctgctgcctctcctgcctgcgctggtcctcagcaccagacaggactatgaagagctagaaaagcagctgaaagaagtctttaaggagcgaagcaccattcttcgtcagctgacaaagacatcaagagaacttgatggaattaaagtcaatcttcagtccttaaaaaacgatgagcagtctgccaaaactgatgttcagaaacttctggaattaggacagaaacaaagagaagaaatgaagtctcttcaggaggccctgcaaaatcagcttaaggagacatcagagaaagcagaaaaacaccaggctactattaattttttaaagactgaagttgaaagaaagagcaaaatgatccgagacctccagaatgagaataaaagcttgaaaaacaaactcttgtcaggaaacaagctctgtggcattcacgcagaagagtcaaaaaaaatccaagcccagctgaaggagcttcgttatgggaagaaggatttattatttaaggcgcagcagcttactgatctggaacaaaaattagctgtagccaaaaatgaactggagaaagcagctcttgacagggagtcacagatgaaagcaatgaaagagactgtgcagctctgcttgacatctgttttccgtgatcagcctcctccccctttgagtttaatcacatcaaatccaactcggatgttactcccacccaggaatattgcctctaagcttccagatgcagcggccaaaagcaagcctcaacaaagtgcttctggaaacaatgagagctctcaagttgagtcaacaaaggaaggaaatccaagtaccactgcctgtgactctcaagatgagggcagaccgtgttccatgaagcacaaagaaagtcccccaagtaatgccactgcagaaaccgagcctatcccacagaaattgcaaatgcctccttgctctgaatgtgaggtgaaaaaagccccagaaaaaccattgaccagctttgaagggatggcagctagagaagaaaaaatactgtaaatactaagaaactgtgttaaaaacgtccatttgctattgtcttcatattctttttagaccacaagcttgatggaaatactgtttctaaagcatgcaactttttcacaattttatgtaactttataaagtagcctacacattttcaaagattccagaccaattatgatccttaagcaataacctcattgaattgaatacccacagtcagaaatattttgttgtcaacagtaaattgtcccatataaattggtctggtttaactcaaatgctatctaacatgtaattctcccggttcatttggatatctagtacttctatgatatagttgtcaaaatcaactggaggataataaaatattgtgggttctcagcattcttagaatccaaattacaaccatatcagtaagggtttggtccacatgagccaactgaagtcattttcctcaaggttggaatttgtgccaacctaaatacgttgtttctttgatggtgtttattgctattggtattattttgaactaataacaattattttgtctaaataatgctaagacaattctgttaagaattttgtcagctaacataattcattaagtatgtttggcatcatatggacaaaatatttggatgaatgactaaatttctgacacaattaaatattttggcattctatagacacatctcctatgtatgtctactgtaattaatccaagttaataaccaagttttctgaaatacttggcaggatttttggtatgaagttgggtagtggaatagggaatgaagagtgagttctaaaatacaaatatgaaagcaggtaatatatatcacaaaacaggggtctgatgaaagtacaatagccatgttgattcaataaacccagatgcatattttttgaaaaccaatgtgttattgaaacaaatcaatggcagtgttaatccataagagttctgattttctataggaatatcactaatcaaaaaaatgcactcatgaataattggaagatagctcacaagcaagaggaattgacccttgaataattatctgattaataggtttcatagggcattcaaagttgcagactcagttaatgactacagttaagttgtctggactgaaaagtcatttcttttgtttagaacctttttgcaaccgtagaaagcatattaaaccattggttttgcaggatggatctgtcaaaccacaatatatacatttggatcagtgtatcctaggagacagttaataaaaatgtattaaaggaaatctttaatcaataaatgaacttagattctgagatttaatggcatacctctgatcaaaatggcatatttaaagaaatttaaagatttggagaattggaaaatatcgttagctgtaaaagtaatattatgacatatttatgtagcacttctattttcagaatagttcagtgtcattcattagcacaggcaggtcccaaccacaatggttcaacttaacggttttttcatgattctgtgaaagcttcataatttctacatgctttgaattttgaattttgttattttttggagggctagtgatacatggtccatgaaatattcaacactttattataaaatagggtttgtgttagacaatttgcccaactgtaggatgaggtatatgttctgagcacgtttaagcaggtttaagttagggtgggctatgattttccatttaggtatctgaaatgcatttcagacttacaatgttttcaacctttgacttctttatctgtatgtaatcctattgttaaatcaaggagcattcatatttttcataaaaccggctacccaaggaaaaaaataattagctttatggatgatccatagagctttcagatgaagtgactaggataaaataaaagatgaaggtctgaggtttcttctgactccttcatatttctaaaaataatcatacaaactagaatactgctagtctcccaagtcctgttccttgtaattctcccactgttctcagtggccctaaccatctctataggttcctgacagggaagcagatcatttagttttaatttatgttcagtctcccacctccaccctggggcccaacttcccttgcaggccttgtgggtcctatagaaagttattcaccatgtaatctagcacagcatgttttgaagcatctttggaatgaaaaaaaagaagaatcaggctgttatttcctgaaattgttatgagagataacatgttgaaaggtaagaactcaggttgatattaatcatgtttttatcaatcttcattttaaagttgtttttgttctgtatattctaaattccttttattaattcctggcttgatcaagtgggctttggatccatatgatttttttttttttttttttttgagatgaaatctcgctcttgttgcccaggctggagtgcaatggagcgatcttgg

SEQ ID NO: 148289 - DNA, 5016 bp, Homo sapiens
  Payload ID: 9358
  Gene Symbol: LUZP2
  Gene Name: leucine zipper protein 2
  Uniprot ID: Q86TE4
  ENST ID: ENST00000533227
  CDS Start-End: 288-1070
agcgagggaaggaggaccccggcaggcagcagcatgaaattcagcccagcgcactacctgctgcctctcctgcctgcgctggtcctcagcaccaggactatgaagagctagaaaagcagctgaaagaagtctttaaggagcgaagcaccattcttcgtcagctgacaaagacatcaagagaacttgatggaattaaagtcaatcttcagtccttaaaaaacgatgagcagtctgccaaaactgatgttcagaaacttctggaattaggacagaaacaaagagaagaaatgaagtctcttcaggaggccctgcaaaatcagcttaaggagacatcagagaaagcagaaaaacaccaggctactattaattttttaaagactgaagttgaaagaaagagcaaaatgatccgagacctccagaatgagaataaaagcttgaaaaacaaactcttgtcaggaaacaagctctgtggcattcacgcagaagagtcaaaaaaaatccaagcccagctgaaggagcttcgttatgggaagaaggatttattatttaaggcgcagcagcttactgatctggaacaaaaattagctgtagccaaaaatgaactggagaaagcagctcttgacagggagtcacagatgaaagcaatgaaagagactgtgcagctctgcttgacatctgttttccgtgatcagcctcctccccctttgagtttaatcacatcaaatccaactcggatgttactcccacccaggaatattgcctctaagcttccagatgcagcggccaaaagcaagcctcaacaaagtgcttctggaaacaatgagagctctcaagttgagtcaacaaaggaaggaaatccaagtaccactgcctgtgactctcaagatgagggcagaccgtgttccatgaagcacaaagaaagtcccccaagtaatgccactgcagaaaccgagcctatcccacagaaattgcaaatgcctccttgctctgaatgtgaggtgaaaaaagccccagaaaaaccattgaccagctttgaagggatggcagctagagaagaaaaaatactgtaaatactaagaaactgtgttaaaaacgtccatttgctattgtcttcatattctttttagaccacaagcttgatggaaatactgtttctaaagcatgcaactttttcacaattttatgtaactttataaagtagcctacacattttcaaagattccagaccaattatgatccttaagcaataacctcattgaattgaatacccacagtcagaaatattttgttgtcaacagtaaattgtcccatataaattggtctggtttaactcaaatgctatctaacatgtaattctcccggttcatttggatatctagtacttctatgatatagttgtcaaaatcaactggaggataataaaatattgtgggttctcagcattcttagaatccaaattacaaccatatcagtaagggtttggtccacatgagccaactgaagtcattttcctcaaggttggaatttgtgccaacctaaatacgttgtttctttgatggtgtttattgctattggtattattttgaactaataacaattattttgtctaaataatgctaagacaattctgttaagaattttgtcagctaacataattcattaagtatgtttggcatcatatggacaaaatatttggatgaatgactaaatttctgacacaattaaatattttggcattctatagacacatctcctatgtatgtctactgtaattaatccaagttaataaccaagttttctgaaatacttggcaggatttttggtatgaagttgggtagtggaatagggaatgaagagtgagttctaaaatacaaatatgaaagcaggtaatatatatcacaaaacaggggtctgatgaaagtacaatagccatgttgattcaataaacccagatgcatattttttgaaaaccaatgtgttattgaaacaaatcaatggcagtgttaatccataagagttctgattttctataggaatatcactaatcaaaaaaatgcactcatgaataattggaagatagctcacaagcaagaggaattgacccttgaataattatctgattaataggtttcatagggcattcaaagttgcagactcagttaatgactacagttaagttgtctggactgaaaagtcatttcttttgtttagaacctttttgcaaccgtagaaagcatattaaaccattggttttgcaggatggatctgtcaaaccacaatatatacatttggatcagtgtatcctaggagacagttaataaaaatgtattaaaggaaatctttaatcaataaatgaacttagattctgagatttaatggcatacctctgatcaaaatggcatatttaaagaaatttaaagatttggagaattggaaaatatcgttagctgtaaaagtaatattatgacatatttatgtagcacttctattttcagaatagttcagtgtcattcattagcacaggcaggtcccaaccacaatggttcaacttaacggttttttcatgattctgtgaaagcttcataatttctacatgctttgaattttgaattttgttattttttggagggctagtgatacatggtccatgaaatattcaacactttattataaaatagggtttgtgttagacaatttgcccaactgtaggatgaggtatatgttctgagcacgtttaagcaggtttaagttagggtgggctatgattttccatttaggtatctgaaatgcatttcagacttacaatgttttcaacctttgacttctttatctgtatgtaatcctattgttaaatcaaggagcattcatatttttcataaaaccggctacccaaggaaaaaaataattagctttatggatgatccatagagctttcagatgaagtgactaggataaaataaaagatgaaggtctgaggtttcttctgactccttcatatttctaaaaataatcatacaaactagaatactgctagtctcccaagtcctgttccttgtaattctcccactgttctcagtggccctaaccatctctataggttcctgacagggaagcagatcatttagttttaatttatgttcagtctcccacctccaccctggggcccaacttcccttgcaggccttgtgggtcctatagaaagttattcaccatgtaatctagcacagcatgttttgaagcatctttggaatgaaaaaaaagaagaatcaggctgttatttcctgaaattgttatgagagataacatgttgaaaggtaagaactcaggttgatattaatcatgtttttatcaatcttcattttaaagttgtttttgttctgtatattctaaattccttttattaattcctggcttgatcaagtgggctttggatccatatgatttttttttttttttttttttgagatgaaatctcgctcttgttgcccaggctggagtgcaatggagcgatcttggctcactgcaactctgcttcccaggttcaagtgattctccctgcctccgcctcccaagtagctgggattacaggtacctgccaccatgcccggctaatttttatatttttaatagagacggggtttcaccatgttggccaggctggtctcgaactcctgacctcaggcgatccacctgcctcagtctcctcccaaaatgctgggattacaggtgtgagccaccgtgcctggccagtgtgtttttttcctttaaatatatatggcattatacatccagcaaagtttactgtgttatactcattgcatcatttgtttaaaaaaaaaaaagaaacttgtagcaggagacatttaaaaatatatttaggagttccttttaataactaagttagagactctctttcagtaagttctatgactgtaccttaatgaatgcattttatttatctcaatttttatttgcttcaaaatagaatcggataagtttaaaatgttcctcttacatttgtgaatgtgtctatgagagaggggccatttctcacatattttaattaacaactaaataaacagacgttgttttaaaggaattaacacttaaatcccaaccatcctcatatagaataaaatatcaacctaaatctttactatagatagtataattctattatgtacctgtaatgataagcattgaaagattatttacattttgaaaaacatggaattgattcttattaagaaaaaagatattttccaatggagtaacttgttttaatagaggtacaaccagaaccaacaattgtatttctctatagttattttaaaatagtaatcaatgctatgtatttgatgtatatgtttctaaattagaaatttcttttggctttgtgtttttttaatgtgcgttaaatatgtaaactgaacctgttcctaaaatgcattaaacttgaatgctgtgtctatccaatgccaaaatgctcagaagaaaagtgaataattcagtcattcatctggatgtagttttctgtgtaatctcaaatatctgaatattgaaaaaactaggttgctaacttttttcattccttatgcaaatgtttagcatcatagtgctgtttcagatacagatctgtttcatcaaatatcctcaattacaagtctaagacagttatatgtaaagaaaatgtattattttagatgaacaatgtggataactgaactaaaacgatatttgtgaactttgctataatgaaatcttttatttttatagctcaggtattgtaattagcactaattgcagcagagactgaaataattattgacaccgtagagtaccatagagtaggttgaactggccagacctagacaatgaagaaaacacatactgtttacttaggagacattttcttagtcgtgtgtatagtcctaaatttccccaaactatgtgttcatttggattgtgttatataataacagtcgaatgatgaagaataaaagatgctgaaagatg

SEQ ID NO: 148290 - DNA, 577 bp, Homo sapiens
  Payload ID: 9358
  Gene Symbol: LUZP2
  Gene Name: leucine zipper protein 2
  ENST ID: ENST00000529015
  CDS Start-End: 50-577
gagagagagagaaggcagcgagggaaggaggaccccggcaggcagcagcatgaaattcagcccagcgcactacctgctgcctctcctgcctgcgctggtcctcagcaccagacaggactatgaagagctagaaaagcagctgaaagaagtctttaaggagcgaagcaccattcttcgtcagctgacaaagacatcaagagaacttgatggaattaaagtcaatcttcagtccttaaaaaacgatgagcagtctgccaaaactgatgttcagaaacttctggaattaggacagaaacaaagagaagaaatgaagtctcttcaggaggccctgcaaaatcagcttaaggagacatcagagaaagcagaaaaacaccaggctactattaattttttaaagactgaagttgaaagaaagagcaaaatgatccgagacctccagaatgaggcgcagcagcttactgatctggaacaaaaattagctgtagccaaaaatgaactggagaaagcagctcttgacagggagtcacagatgaaagcaatgaaagagactgtgcagctctgcttgacatctgttttc

SEQ ID NO: 148291 - DNA, 4981 bp, Homo sapiens
  Payload ID: 9358
  Gene Symbol: LUZP2
  Gene Name: leucine zipper protein 2
  Uniprot ID: Q86TE4
  ENST ID: ENST00000620308
  CDS Start-End: 226-1008
ggctctcatgcctgttctttctgtgttagacaggactatgaagagctagaaaagcagctgaaagaagtctttaaggagcgaagcaccattcttcgtcagctgacaaagacatcaagagaacttgatggaattaaagtcaatcttcagtccttaaaaaacgatgagcagtctgccaaaactgatgttcagaaacttctggaattaggacagaaacaaagagaagaaatgaagtctcttcaggaggccctgcaaaatcagcttaaggagacatcagagaaagcagaaaaacaccaggctactattaattttttaaagactgaagttgaaagaaagagcaaaatgatccgagacctccagaatgagaataaaagcttgaaaaacaaactcttgtcaggaaacaagctctgtggcattcacgcagaagagtcaaaaaaaatccaagcccagctgaaggagcttcgttatgggaagaaggatttattatttaaggcgcagcagcttactgatctggaacaaaaattagctgtagccaaaaatgaactggagaaagcagctcttgacagggagtcacagatgaaagcaatgaaagagactgtgcagctctgcttgacatctgttttccgtgatcagcctcctccccctttgagtttaatcacatcaaatccaactcggatgttactcccacccaggaatattgcctctaagcttccagatgcagcggccaaaagcaagcctcaacaaagtgcttctggaaacaatgagagctctcaagttgagtcaacaaaggaaggaaatccaagtaccactgcctgtgactctcaagatgagggcagaccgtgttccatgaagcacaaagaaagtcccccaagtaatgccactgcagaaaccgagcctatcccacagaaattgcaaatgcctccttgctctgaatgtgaggtgaaaaaagccccagaaaaaccattgaccagctttgaagggatggcagctagagaagaaaaaatactgtaaatactaagaaactgtgttaaaaacgtccatttgctattgtcttcatattctttttagaccacaagcttgatggaaatactgtttctaaagcatgcaactttttcacaattttatgtaactttataaagtagcctacacattttcaaagattccagaccaattatgatccttaagcaataacctcattgaattgaatacccacagtcagaaatattttgttgtcaacagtaaattgtcccatataaattggtctggtttaactcaaatgctatctaacatgtaattctcccggttcatttggatatctagtacttctatgatatagttgtcaaaatcaactggaggataataaaatattgtgggttctcagcattcttagaatccaaattacaaccatatcagtaagggtttggtccacatgagccaactgaagtcattttcctcaaggttggaatttgtgccaacctaaatacgttgtttctttgatggtgtttattgctattggtattattttgaactaataacaattattttgtctaaataatgctaagacaattctgttaagaattttgtcagctaacataattcattaagtatgtttggcatcatatggacaaaatatttggatgaatgactaaatttctgacacaattaaatattttggcattctatagacacatctcctatgtatgtctactgtaattaatccaagttaataaccaagttttctgaaatacttggcaggatttttggtatgaagttgggtagtggaatagggaatgaagagtgagttctaaaatacaaatatgaaagcaggtaatatatatcacaaaacaggggtctgatgaaagtacaatagccatgttgattcaataaacccagatgcatattttttgaaaaccaatgtgttattgaaacaaatcaatggcagtgttaatccataagagttctgattttctataggaatatcactaatcaaaaaaatgcactcatgaataattggaagatagctcacaagcaagaggaattgacccttgaataattatctgattaataggtttcatagggcattcaaagttgcagactcagttaatgactacagttaagttgtctggactgaaaagtcatttcttttgtttagaacctttttgcaaccgtagaaagcatattaaaccattggttttgcaggatggatctgtcaaaccacaatatatacatttggatcagtgtatcctaggagacagttaataaaaatgtattaaaggaaatctttaatcaataaatgaacttagattctgagatttaatggcatacctctgatcaaaatggcatatttaaagaaatttaaagatttggagaattggaaaatatcgttagctgtaaaagtaatattatgacatatttatgtagcacttctattttcagaatagttcagtgtcattcattagcacaggcaggtcccaaccacaatggttcaacttaacggttttttcatgattctgtgaaagcttcataatttctacatgctttgaattttgaattttgttattttttggagggctagtgatacatggtccatgaaatattcaacactttattataaaatagggtttgtgttagacaatttgcccaactgtaggatgaggtatatgttctgagcacgtttaagcaggtttaagttagggtgggctatgattttccatttaggtatctgaaatgcatttcagacttacaatgttttcaacctttgacttctttatctgtatgtaatcctattgttaaatcaaggagcattcatatttttcataaaaccggctacccaaggaaaaaaataattagctttatggatgatccatagagctttcagatgaagtgactaggataaaataaaagatgaaggtctgaggtttcttctgactccttcatatttctaaaaataatcatacaaactagaatactgctagtctcccaagtcctgttccttgtaattctcccactgttctcagtggccctaaccatctctataggttcctgacagggaagcagatcatttagttttaatttatgttcagtctcccacctccaccctggggcccaacttcccttgcaggccttgtgggtcctatagaaagttattcaccatgtaatctagcacagcatgttttgaagcatctttggaatgaaaaaaaagaagaatcaggctgttatttcctgaaattgttatgagagataacatgttgaaaggtaagaactcaggttgatattaatcatgtttttatcaatcttcattttaaagttgtttttgttctgtatattctaaattccttttattaattcctggcttgatcaagtgggctttggatccatatgatttttttttttttttttttttgagatgaaatctcgctcttgttgcccaggctggagtgcaatggagcgatcttggctcactgcaactctgcttcccaggttcaagtgattctccctgcctccgcctcccaagtagctgggattacaggtacctgccaccatgcccggctaatttttatatttttaatagagacggggtttcaccatgttggccaggctggtctcgaactcctgacctcaggcgatccacctgcctcagtctcctcccaaaatgctgggattacaggtgtgagccaccgtgcctggccagtgtgtttttttcctttaaatatatatggcattatacatccagcaaagtttactgtgttatactcattgcatcatttgtttaaaaaaaaaaaagaaacttgtagcaggagacatttaaaaatatatttaggagttccttttaataactaagttagagactctctttcagtaagttctatgactgtaccttaatgaatgcattttatttatctcaatttttatttgcttcaaaatagaatcggataagtttaaaatgttcctcttacatttgtgaatgtgtctatgagagaggggccatttctcacatattttaattaacaactaaataaacagacgttgttttaaaggaattaacacttaaatcccaaccatcctcatatagaataaaatatcaacctaaatctttactatagatagtataattctattatgtacctgtaatgataagcattgaaagattatttacattttgaaaaacatggaattgattcttattaagaaaaaagatattttccaatggagtaacttgttttaatagaggtacaaccagaaccaacaattgtatttctctatagttattttaaaatagtaatcaatgctatgtatttgatgtatatgtttctaaattagaaatttcttttggctttgtgtttttttaatgtgcgttaaatatgtaaactgaacctgttcctaaaatgcattaaacttgaatgctgtgtctatccaatgccaaaatgctcagaagaaaagtgaataattcagtcattcatctggatgtagttttctgtgtaatctcaaatatctgaatattgaaaaaactaggttgctaacttttttcattccttatgcaaatgtttagcatcatagtgctgtttcagatacagatctgtttcatcaaatatcctcaattacaagtctaagacagttatatgtaaagaaaatgtattattttagatgaacaatgtggataactgaactaaaacgatatttgtgaactttgctataatgaaatcttttatttttatagctcaggtattgtaattagcactaattgcagcagagactgaaataattattgacaccgtagagtaccatagagtaggttgaactggccagacctagacaatgaagaaaacacatactgtttacttaggagacattttcttagtcgtgtgtatagtcctaaatttccccaaactatgtgttcatttggattgtgttatataataacagtcgaatgatgaagaataaaagatgctgaaagatggcctatttttgttcaataaagattgtt

SEQ ID NO: 148292 - DNA, 1701 bp, Homo sapiens
  Payload ID: 9359
  Gene Symbol: LUZP4
  Gene Name: leucine zipper protein 4
  Uniprot ID: Q9P127
  ENST ID: ENST00000371920
  CDS Start-End: 8-949
agggaagatggcttcgtttcggaagctaacgctttctgaaaaagtgccgccaaatcatcccagtcggaaaaaggttaacttcctagatatgtctctagacgacattataatctataaagagttagaagggacaaatgctgaagaagaaaagaataaaagacagaaccatagtaaaaaggaatcgccttcaagacagcaatcaaaagctcatagacatcgccatcggagaggctactcaagatgcagaagcaactctgaggaaggaaatcatgataaaaaaccatcccaaaaaccttctggattcaagtctggacaacaccctttaaatgggcagcctttaattgagcaggagaagtgcagtgacaattatgaggcccaagcagagaagaatcaaggccagtcagaggggaaccagcatcaatcagaaggaaatccggacaaatcagaagaatcccagggccaaccagaagaaaatcatcattctgagcgatcccgaaaccacttagagagatctctttctcagtcagacagatctcaagggcagctaaagagacatcatccccaatatgagagatctcatggccaatacaagagatctcatggtcaatctgagagatctcatggccactcagagagatctcatggtcactcagagagatctcatggtcactcagagagatctcatggtcactcaaagagatctcgtagccagggagatcttgtggacactcagagtgatctcatagccactcagagagatctcatagccactcagaaagatctcatagccactcagagagatctcatagccactcagagagatctcatagtcactcagagagatctcgtggccactgagagagatctcataaatcagtcagggagatctcatggccaatcagaaagacatcagagatactcaacaggtaaaaatacaataactacttaatcatcagaacaatgtgttgaattctgtggaaatagaaaagcatatatctatattctaatggctaaatatgtatttgttgaaacatgtatattgggacaaagacataaatattagaatggaggtaatacatacatagtatcaatattgtttcaacttgatgtcctctaagctatcatccagttacccaggatgtcccattaagttgttcccggtaggtctgctttccctggaagagccgtatgtactcagcctttcctattgggccttccccacaattagaatattttgacttagtgtcctgtcccccttggacgttccaacttgacttagtgtccagtgccccttggacattccaacctggtaggtaagctaatctaacaactaactgccaaattgataatatataatctatgataatgaatatctcttttgtgtctccttcctaagccatcctcagagagtccttagcagacaaatggtagatgtatctttgggcagctgaacttttctgctttcctcaaatcagaccatatgagaggatatattctatgcatagatgtaatgctaaccttctgaatatattttgaatacatttatatattcactgttgccttataaaactgttagggtaggtctgtctaccctagcaaaagaaacacagaaatttaaatgtactgggagttatgttgttaaaaacacaagatatgttaactgcagtttgtttggttattcaataaaagttttagttttaa

SEQ ID NO: 148293 - DNA, 1606 bp, Homo sapiens
  Payload ID: 9359
  Gene Symbol: LUZP4
  Gene Name: leucine zipper protein 4
  ENST ID: ENST00000371921
  CDS Start-End: 34-270
cctcggagtgtgtggcgccatgatgcagggaagatggcttcgtttcggaagctaacgctttctgaaaaagtgccgccaaatcatcccagtcggaaaaaggttaacttcctagatatgtctctagacgacattataatctataaagagttagaagggacaaatgctgaagaagaaaagaataaaagacagaaccatagtaaaaaggaatcgccttcaagacagcaatcaaaagctcatagacatcgccatcggagaggagaagtgcagtgacaattatgaggcccaagcagagaagaatcaaggccagtcagaggggaaccagcatcaatcagaaggaaatccggacaaatcagaagaatcccagggccaaccagaagaaaatcatcattctgagcgatcccgaaaccacttagagagatctctttctcagtcagacagatctcaagggcagctaaagagacatcatccccaatatgagagatctcatggccaatacaagagatctcatggtcaatctgagagatctcatggccactcagagagatctcatggtcactcagagagatctcatggtcactcagagagatctcatggtcactcaaagagatctcgtagccagggagatcttgtggacactcagagtgatctcatagccactcagagagatctcatagccactcagaaagatctcatagccactcagagagatctcatagccactcagagagatctcatagtcactcagagagatctcgtggccactgagagagatctcataaatcagtcagggagatctcatggccaatcagaaagacatcagagatactcaacaggtaaaaatacaataactacttaatcatcagaacaatgtgttgaattctgtggaaatagaaaagcatatatctatattctaatggctaaatatgtatttgttgaaacatgtatattgggacaaagacataaatattagaatggaggtaatacatacatagtatcaatattgtttcaacttgatgtcctctaagctatcatccagttacccaggatgtcccattaagttgttcccggtaggtctgctttccctggaagagccgtatgtactcagcctttcctattgggccttccccacaattagaatattttgacttagtgtcctgtcccccttggacgttccaacttgacttagtgtccagtgccccttggacattccaacctggtaggtaagctaatctaacaactaactgccaaattgataatatataatctatgataatgaatatctcttttgtgtctccttcctaagccatcctcagagagtccttagcagacaaatggtagatgtatctttgggcagctgaacttttctgctttcctcaaatcagaccatatgagaggatatattctatgcatagatgtaatgctaaccttctgaatatattttgaatacatttatatattcactgttgccttataaaactgttagggtaggtctgtctaccctagcaaaagaaacacagaaatttaaatgtactgggagttatgttgttaaaaacacaagatatgttaactgcagtttgtttggttattcaataaaagttttagtttt

SEQ ID NO: 148294 - DNA, 177 bp, Homo sapiens
  Payload ID: 9360
  Gene Symbol: LUZP6
  Gene Name: leucine zipper protein 6
  Uniprot ID: Q538Z0
  ENST ID: ENST00000589735
  CDS Start-End: 1-177
attaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaa

SEQ ID NO: 148295 - DNA, 5257 bp, Homo sapiens
  Payload ID: 9361
  Gene Symbol:
  Gene Name: Leucine zipper putative tumor suppressor 3  [Source:UniProtKB/Swiss-Prot
  Acc:O60299]
  Uniprot ID: O60299
  ENST ID: ENST00000329152
  CDS Start-End: 1399-3420
cgcttgtgggccggccttgggggagggggacgcgcacccacagaaggactcagagggcttcacggtaagctgagcagggtcaaggtccacagggagcgggagagggtagtaatccgggaagtcttcctggtggcagtgaattctttgcggggttcggcaggcgcaggatccttggggccgcgcaccctgcagcggcccctcccctcccctcccccctcccacctgtgggaaacgcaggccctgagagaggctccgtcagtgccagcagctggcgccactgcgtcccctgccccggcctcagccagccctgggacctctgcggaggactgatcccgggaagggggccctgtcttcccagggccccggtgcggccgagctgggaagaccttggggagggcaggcctgccacctactgcagccgcggcccccgtccatccgggagggacaggctgtgcccttggcggcgcccacccgcgacccagatgtgcgtcgcctacccaccctcccccagacccccgtttcctcaggcgctcgccgcctcggggcgcctggcacgcggcagccccgcaaggtaggtccttcattcctcccatttcgcagaggagaaaactgcagtccgggatggctcagtcggcccctccaaagtcgcgcagctggttcgggccgagccccgactgcgagagtgaggcacatggcccctgcagaccgggcctcggagggtcccaggcttgaggacccgtcggcccctcaaccccttggaaaggcaaggagagaagcctgcgctggtagtgagcttccacttctgccctgactgcaacacttaggttagggggctgggaaggacccccaccctcaatttttggataggggtgtatttctctccctcccctaatttctgaggttggttccctgttggattcaggtactgctctccccttccaaccccatttccccagcccatgaggttgggatattagggtcccagacccaagataaagaaccccaaaattctggggttgcagcaaagagttgagagggtcactgagcctgggaagctcatggcggaggtggggctaaggcagaagtttaggaatggaacgctgagctgagctgagctgagctgagctgagcaacgctgggggctatgtgcatggagccctgggggttgggctttatcaggtgggcaacaggcagcccccattcccaagttctctcttttatcccagccttattccttcaccttggatgcctgggaactttttgtacccattgtagggaaggggacactgaggggcagagcggtgccgggttgacttggctggggtggtgggaataggagtagggtcttacctatctctgccttcccacctgtgcccacagtgcccccctggcttagtcatggcgaagctggagacgctgcctgtgcgcgctgacccagggcgggatcctctcctggcctttgccccacggccctccgagcttggacccccggacccccgcctggccatgggcagcgtgggcagtggggtggcccatgcccaggagtttgccatgaagagcgtgggtacccgcacagggggtgggggcagccagggcagtttccctggcccccgaggcagtggcagtggggccagcagggagaggccgggccgctacccctcagaggacaagggtctcgccaactccctctacctcaatggtgagctgcggggcagtgaccacaccgatgtctgtggcaacgtggttggcagcagcggaggcagcagcagcagtggtggcagtgacaaagccccaccgcagtatcgtgagcccagccacccacccaagctcctggccacctctggcaagctagaccagtgctcagaaccactagttcggccgtcggccttcaagcctgtcgtacccaagaatttccactccatgcagaatttgtgccccccgcagaccaatgggactcctgagggacggcagggccctggtggcctcaaaggcggactggacaagtctcggaccatgactccagcgggtgggagtgggagtggcctctcagactcaggccggaactccctcacaagcctgcccacctacagctccagctacagccagcacctggcacccctcagtgcctccaccagccacattaaccgcattggcactgccagctatggtagtggtagtggcggcagcagcggtggggggtcgggctaccaggacctggggacctccgatagtggacgggcctccagcaagagtgggtcgtcgtcatctatggggcggccaggccacctgggctctggggagggcggaggtggaggcctgcctttcgcggcctgctcaccgccctcccccagtgcactcatccaggagctggaggagcggctgtgggagaaggagcaggaggtggcagctctgcggcgcagcctggagcagagcgaggcggctgtggcccaggtactggaggagcggcagaaggcgtgggagcgggagctggccgagctgcggcagggctgcagcgggaagctacagcaggtggcccgacgtgcccagcgcgcccagcagggcctacagctgcaggtgttgcggctgcagcaggacaagaagcagctgcaggaggaggcggcccggctgatgcggcagcgggaagagctggaggacaaggtggccgcctgccagaaggagcaggccgacttcctgccccggatagaggaaactaagtgggaggtgtgccagaaggctggcgagatctccctcctgaagcagcagctgaaggactcgcaggcggatgtgtcgcagaagttgagtgagatcgtgggactgcgctcgcagctgcgggagggccgggcttcgctgcgggagaaggaggagcagctgctcagcctgcgggactccttcagcagcaagcaggccagcctggagctgggcgaaggcgagctgcctgccgcctgcctcaagccggcgctgacccccgtggacccggccgagccacaggatgctctggccacctgcgagagcgacgaggctaagatgcgccgtcaggccggggtggccgctgccgcctccttggtttccgtggacggggaggcggaggctggcggggagagcgggacgcgggccctgcggcgggaggtggggcggctgcaggccgagctggcggctgagcggcgggcccgggagcgccagggtgccagcttcgccgaggagcgccgcgtgtggctggaggagaaggagaaggtgatcgagtaccagaagcagctgcagctgagctacgtggagatgtaccagcgcaaccagcagctggagcgcaggctgcgggagcgcggggccgcagggggtgcaagcacgcccactccccagcatggcgaggagaagaaggcctggaccccctcccgcctcgagcgcattgagtccacagaaatctgatcgacctgggcactcggcattttgacacatgtcctgtcaaaaggccagagtccccagtgtcccctcccctccatctctcttccccatagaccccataaccccagaccaaagaggttctctaagcagctgtgaccaggttcctccctccccacctgccctcctagctccagcactgcccccgtggcagcccacttggacccccctaaaaggagggaataggaggagggcagggtgagtgggggcaatcctaggtggtgggggagtcatgctccctttctcggcacccccttgttggagatggaggcagcagacgtgcagtgccataaggtgccccagtccttctggaggcctgggctgctactgttggccaccctgtgtctagtgatgctctctgtgctcacctcctaggccatggagcctgagggggcctgcaccaggtttgctgaaactgacagagcctgggctccagacctctctccctcctacagtgctctccctccctgggcagattggcaggacaagtgggagcagatggcctgcctttggctgagagggctacctgcccagcccctcccccaacaagatctcttggactcaggcctcagagcctggcctggttgtgagtgtgtgtccctgtgtgtgtgttgcgggaggggaggactggggctggaagtccagcacccagggaagatctgtcctcctgttcttgggaagcgttgcctgacggcttctcggctctaccctcacccttctggccaggatcccgcagggcaacagccccatctgcttggctgaccccacacccaggaccactgtccggctctaacacagctattaagtgctacctgcctctcaggcactctcctcgcccagtttctgaggtcagacgagtgtctgcgatgtcttcccgcactctattcccccagcctctttctgctttcatgctcagcacatcatcttcctaggcagtctcttccccaaagtctcaccttttcttccaatagaaaattccgcttgacctttggtgcactgcccacttcccagctccactggcccaagtctgagccggaggcccttgttttgggggcggggggagagttggatgtgattgcccttgaagaacaaggctgacctgagaggttcctggcgccctgaggtggctcagcacctgcccagggtaggcctggcatgaggggttaggtcagccaatgtcagctgcttctcttggggccctctcagagtctatctccccaagacaggaagggaaaagcaaatttctaattcaccagcaataaaaattggaggaggcttggccctcagcccttatatctctctctttttcactctcttcctcccacccccaagactgagttttggggggcaaggtggagagagctggcaactactgtgagcaagtcccctagcccctgaccagcctcctcccatgactggtgactgtttaatgagctgtgcatcccccacaaaaacatgagtgcccctctgtgtggcctctaaccctctgcacagcccttctgggtggtcctcaccaggtctctgagctgggtgggaggccatcctggcgaccactgcccattccattcacccctcactgtacctgccctagaacctgggcctaggccacaggggcagggagaagagaaggcattagtaagaaaaaaatagaaaaaaatatgaacagactcagctttgggacgtccaaccacaaaagaaattatatataaatatatataaatatatatctctaccatatgtgatggaaagactttttgttttcctttcccaaagaaataaaacggaaaaagcctcttgagtggta

SEQ ID NO: 148296 - DNA, 4238 bp, Homo sapiens
  Payload ID: 9361
  Gene Symbol:
  Gene Name: Leucine zipper putative tumor suppressor 3  [Source:UniProtKB/Swiss-Prot
  Acc:O60299]
  Uniprot ID: O60299
  ENST ID: ENST00000337576
  CDS Start-End: 381-2402
tcgggcggggagcaggaggggcgcggagcggagccgggcccgcgcagcgcgccccgccgggcgtgcttcgggctgcgccagcaagcggggccggtggcgcccgtgtcggagaccccgcgccggaccctgaggcagcgaaggagaaaactgcagtccgggatggctcagtcggcccctccaaagtcgcgcagctggttcgggccgagccccgactgcgagagtgaggcacatggcccctgcagaccgggcctcggagggtcccaggcttgaggacccgtcggcccctcaaccccttggaaaggcaaggagagaagcctgcgctggtagtgagcttccacttctgccctgactgcaacacttagtgcccccctggcttagtcatggcgaagctggagacgctgcctgtgcgcgctgacccagggcgggatcctctcctggcctttgccccacggccctccgagcttggacccccggacccccgcctggccatgggcagcgtgggcagtggggtggcccatgcccaggagtttgccatgaagagcgtgggtacccgcacagggggtgggggcagccagggcagtttccctggcccccgaggcagtggcagtggggccagcagggagaggccgggccgctacccctcagaggacaagggtctcgccaactccctctacctcaatggtgagctgcggggcagtgaccacaccgatgtctgtggcaacgtggttggcagcagcggaggcagcagcagcagtggtggcagtgacaaagccccaccgcagtatcgtgagcccagccacccacccaagctcctggccacctctggcaagctagaccagtgctcagaaccactagttcggccgtcggccttcaagcctgtcgtacccaagaatttccactccatgcagaatttgtgccccccgcagaccaatgggactcctgagggacggcagggccctggtggcctcaaaggcggactggacaagtctcggaccatgactccagcgggtgggagtgggagtggcctctcagactcaggccggaactccctcacaagcctgcccacctacagctccagctacagccagcacctggcacccctcagtgcctccaccagccacattaaccgcattggcactgccagctatggtagtggtagtggcggcagcagcggtggggggtcgggctaccaggacctggggacctccgatagtggacgggcctccagcaagagtgggtcgtcgtcatctatggggcggccaggccacctgggctctggggagggcggaggtggaggcctgcctttcgcggcctgctcaccgccctcccccagtgcactcatccaggagctggaggagcggctgtgggagaaggagcaggaggtggcagctctgcggcgcagcctggagcagagcgaggcggctgtggcccaggtactggaggagcggcagaaggcgtgggagcgggagctggccgagctgcggcagggctgcagcgggaagctacagcaggtggcccgacgtgcccagcgcgcccagcagggcctacagctgcaggtgttgcggctgcagcaggacaagaagcagctgcaggaggaggcggcccggctgatgcggcagcgggaagagctggaggacaaggtggccgcctgccagaaggagcaggccgacttcctgccccggatagaggaaactaagtgggaggtgtgccagaaggctggcgagatctccctcctgaagcagcagctgaaggactcgcaggcggatgtgtcgcagaagttgagtgagatcgtgggactgcgctcgcagctgcgggagggccgggcttcgctgcgggagaaggaggagcagctgctcagcctgcgggactccttcagcagcaagcaggccagcctggagctgggcgaaggcgagctgcctgccgcctgcctcaagccggcgctgacccccgtggacccggccgagccacaggatgctctggccacctgcgagagcgacgaggctaagatgcgccgtcaggccggggtggccgctgccgcctccttggtttccgtggacggggaggcggaggctggcggggagagcgggacgcgggccctgcggcgggaggtggggcggctgcaggccgagctggcggctgagcggcgggcccgggagcgccagggtgccagcttcgccgaggagcgccgcgtgtggctggaggagaaggagaaggtgatcgagtaccagaagcagctgcagctgagctacgtggagatgtaccagcgcaaccagcagctggagcgcaggctgcgggagcgcggggccgcagggggtgcaagcacgcccactccccagcatggcgaggagaagaaggcctggaccccctcccgcctcgagcgcattgagtccacagaaatctgatcgacctgggcactcggcattttgacacatgtcctgtcaaaaggccagagtccccagtgtcccctcccctccatctctcttccccatagaccccataaccccagaccaaagaggttctctaagcagctgtgaccaggttcctccctccccacctgccctcctagctccagcactgcccccgtggcagcccacttggacccccctaaaaggagggaataggaggagggcagggtgagtgggggcaatcctaggtggtgggggagtcatgctccctttctcggcacccccttgttggagatggaggcagcagacgtgcagtgccataaggtgccccagtccttctggaggcctgggctgctactgttggccaccctgtgtctagtgatgctctctgtgctcacctcctaggccatggagcctgagggggcctgcaccaggtttgctgaaactgacagagcctgggctccagacctctctccctcctacagtgctctccctccctgggcagattggcaggacaagtgggagcagatggcctgcctttggctgagagggctacctgcccagcccctcccccaacaagatctcttggactcaggcctcagagcctggcctggttgtgagtgtgtgtccctgtgtgtgtgttgcgggaggggaggactggggctggaagtccagcacccagggaagatctgtcctcctgttcttgggaagcgttgcctgacggcttctcggctctaccctcacccttctggccaggatcccgcagggcaacagccccatctgcttggctgaccccacacccaggaccactgtccggctctaacacagctattaagtgctacctgcctctcaggcactctcctcgcccagtttctgaggtcagacgagtgtctgcgatgtcttcccgcactctattcccccagcctctttctgctttcatgctcagcacatcatcttcctaggcagtctcttccccaaagtctcaccttttcttccaatagaaaattccgcttgacctttggtgcactgcccacttcccagctccactggcccaagtctgagccggaggcccttgttttgggggcggggggagagttggatgtgattgcccttgaagaacaaggctgacctgagaggttcctggcgccctgaggtggctcagcacctgcccagggtaggcctggcatgaggggttaggtcagccaatgtcagctgcttctcttggggccctctcagagtctatctccccaagacaggaagggaaaagcaaatttctaattcaccagcaataaaaattggaggaggcttggccctcagcccttatatctctctctttttcactctcttcctcccacccccaagactgagttttggggggcaaggtggagagagctggcaactactgtgagcaagtcccctagcccctgaccagcctcctcccatgactggtgactgtttaatgagctgtgcatcccccacaaaaacatgagtgcccctctgtgtggcctctaaccctctgcacagcccttctgggtggtcctcaccaggtctctgagctgggtgggaggccatcctggcgaccactgcccattccattcacccctcactgtacctgccctagaacctgggcctaggccacaggggcagggagaagagaaggcattagtaagaaaaaaatagaaaaaaatatgaacagactcagctttgggacgtccaaccacaaaagaaattatatataaatatatataaatatatatctctaccatatgtgatggaaagactttttgttttcctttcccaaagaaataaaacggaaaaagcctcttgagtggt

SEQ ID NO: 148297 - DNA, 4055 bp, Homo sapiens
  Payload ID: 9361
  Gene Symbol:
  Gene Name: Leucine zipper putative tumor suppressor 3  [Source:UniProtKB/Swiss-Prot
  Acc:O60299]
  ENST ID: ENST00000360342
  CDS Start-End: 335-2218
gcgcgccccgccgggcgtgcttcgggctgcgccagcaagcggggccggtggcgcccgtgtcggagaccccgcgccggaccctgaggcagcgaaggagaaaactgcagtccgggatggctcagtcggcccctccaaagtcgcgcagctggttcgggccgagccccgactgcgagagtgaggcacatggcccctgcagaccgggcctcggagggtcccaggcttgaggacccgtcggcccctcaaccccttggaaaggcaaggagagaagcctgcgctggtagtgagcttccacttctgccctgactgcaacacttagtgcccccctggcttagtcatggcgaagctggagacgctgcctgtgcgcgctgacccagggcgggatcctctcctggcctttgccccacggccctccgagcttggacccccggacccccgcctggccatgggcagcgtgggcagtggggtggcccatgcccaggagtttgccatgaagagcgtgggtacccgcacagggggtgggggcagccagggcagtttccctggcccccgaggcagtggcagtggggccagcagggagaggccgggccgctacccctcagaggacaagggtctcgccaactccctctacctcaatggtgagctgcggggcagtgaccacaccgatgtctgtggcaacgtggttggcagcagcggaggcagcagcagcagtggtggcagtgacaaagccccaccgcagtatcgtgagcccagccacccacccaagctcctggccacctctggcaagctagaccagtgctcagaaccactagttcggccgtcggccttcaagcctgtcgtacccaagaatttccactccatgcagaatttgtgccccccgcagaccaatgggactcctgagggacggcagggccctggtggcctcaaaggcggactggacaagtctcggaccatgactccagcgggtgggagtgggagtggcctctcagactcaggccggaactccctcacaagcctgcccacctacagctccagctacagccagcacctggcacccctcagtgcctccaccagccacattaaccgcattggcactgccagctatggtagtggtagtggcggcagcagcggtggggggtcgggctaccaggacctggggacctccgatagtggacgggcctccagcaagagtgggtcgtcgtcatctatggggcggccaggccacctgggctctggggagggcggaggtggaggcctgcctttcgcggcctgctcaccgccctcccccagtgcactcatccaggagctggaggagcggctgtgggagaaggagcaggaggtggcagctctgcggcgcagcctggagcagagcgaggcggctgtggcccagcaggacaagaagcagctgcaggaggaggcggcccggctgatgcggcagcgggaagagctggaggacaaggtggccgcctgccagaaggagcaggccgacttcctgccccggatagaggaaactaagtgggaggtgtgccagaaggctggcgagatctccctcctgaagcagcagctgaaggactcgcaggcggatgtgtcgcagaagttgagtgagatcgtgggactgcgctcgcagctgcgggagggccgggcttcgctgcgggagaaggaggagcagctgctcagcctgcgggactccttcagcagcaagcaggccagcctggagctgggcgaaggcgagctgcctgccgcctgcctcaagccggcgctgacccccgtggacccggccgagccacaggatgctctggccacctgcgagagcgacgaggctaagatgcgccgtcaggccggggtggccgctgccgcctccttggtttccgtggacggggaggcggaggctggcggggagagcgggacgcgggccctgcggcgggaggtggggcggctgcaggccgagctggcggctgagcggcgggcccgggagcgccagggtgccagcttcgccgaggagcgccgcgtgtggctggaggagaaggagaaggtgatcgagtaccagaagcagctgcagctgagctacgtggagatgtaccagcgcaaccagcagctggagcgcaggctgcgggagcgcggggccgcagggggtgcaagcacgcccactccccagcatggcgaggagaagaaggcctggaccccctcccgcctcgagcgcattgagtccacagaaatctgatcgacctgggcactcggcattttgacacatgtcctgtcaaaaggccagagtccccagtgtcccctcccctccatctctcttccccatagaccccataaccccagaccaaagaggttctctaagcagctgtgaccaggttcctccctccccacctgccctcctagctccagcactgcccccgtggcagcccacttggacccccctaaaaggagggaataggaggagggcagggtgagtgggggcaatcctaggtggtgggggagtcatgctccctttctcggcacccccttgttggagatggaggcagcagacgtgcagtgccataaggtgccccagtccttctggaggcctgggctgctactgttggccaccctgtgtctagtgatgctctctgtgctcacctcctaggccatggagcctgagggggcctgcaccaggtttgctgaaactgacagagcctgggctccagacctctctccctcctacagtgctctccctccctgggcagattggcaggacaagtgggagcagatggcctgcctttggctgagagggctacctgcccagcccctcccccaacaagatctcttggactcaggcctcagagcctggcctggttgtgagtgtgtgtccctgtgtgtgtgttgcgggaggggaggactggggctggaagtccagcacccagggaagatctgtcctcctgttcttgggaagcgttgcctgacggcttctcggctctaccctcacccttctggccaggatcccgcagggcaacagccccatctgcttggctgaccccacacccaggaccactgtccggctctaacacagctattaagtgctacctgcctctcaggcactctcctcgcccagtttctgaggtcagacgagtgtctgcgatgtcttcccgcactctattcccccagcctctttctgctttcatgctcagcacatcatcttcctaggcagtctcttccccaaagtctcaccttttcttccaatagaaaattccgcttgacctttggtgcactgcccacttcccagctccactggcccaagtctgagccggaggcccttgttttgggggcggggggagagttggatgtgattgcccttgaagaacaaggctgacctgagaggttcctggcgccctgaggtggctcagcacctgcccagggtaggcctggcatgaggggttaggtcagccaatgtcagctgcttctcttggggccctctcagagtctatctccccaagacaggaagggaaaagcaaatttctaattcaccagcaataaaaattggaggaggcttggccctcagcccttatatctctctctttttcactctcttcctcccacccccaagactgagttttggggggcaaggtggagagagctggcaactactgtgagcaagtcccctagcccctgaccagcctcctcccatgactggtgactgtttaatgagctgtgcatcccccacaaaaacatgagtgcccctctgtgtggcctctaaccctctgcacagcccttctgggtggtcctcaccaggtctctgagctgggtgggaggccatcctggcgaccactgcccattccattcacccctcactgtacctgccctagaacctgggcctaggccacaggggcagggagaagagaaggcattagtaagaaaaaaatagaaaaaaatatgaacagactcagctttgggacgtccaaccacaaaagaaattatatataaatatatataaatatatatctctaccatatgtgatggaaagactttttgttttcctttcccaaagaaataaaacggaaaaagcctcttgagtggta

SEQ ID NO: 148298 - DNA, 4073 bp, Homo sapiens
  Payload ID: 9362
  Gene Symbol: LZTFL1
  Gene Name: leucine zipper transcription factor-like 1
  Uniprot ID: Q9NQ48
  ENST ID: ENST00000296135
  CDS Start-End: 176-1075
gaaaatgcataattgcagtccacgtgcctcggtttccgttagcaaccagaggcttctaaacaacctaccctccttccccattttctgtggtccaactaccctcggcgatcccaggcttggcggggcaccgcctggcctctcccgttcctttaggctgccgccgctgcctgccgccatggcagagttgggcctaaatgagcaccatcaaaatgaagttattaattatatgcgttttgctcgttcaaagagaggcttgagactcaaaactgtagattcctgcttccaagacctcaaggagagcaggctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaaggaattagaaaagaaatttcagcaaacagcagcttatcgaaacatgaaagagattcttaccaagaagaatgaccaaatcaaagatctgaggaaaagactggcacaatatgaacctgaagattaaaactgaagatttcctctggaagctaccacatgcaaacatacaagcagtctcacctcaggcatgtattttgaaaagcattttgtcatatcccctctccttatttttctaatatttagactttgaatatttagaactagagttcctattttcagctagttgaaaacagagaaaacctagtgattctgtctggtcatcccacacacctctctactgagtgctccagagtcttagctcacatgcactgagaattctttacagcaaagaagagatttttagagtgggaagaagaggcttatccttctgcattagtataaagagtctgtatttttaataaatgttaaataagctaacaatgtttgtacttatgcattccccatgggtaaaaataaataatagcattgttaaagatagttattaccaaaaaaagagagttattacaaataaatatgtctctttatttttaaaaatgaaatcttaattcatttactctatttgatgataaactataaattcattgaaaatgtgaattctattatgggtagcctttttaccaattataaggaaaatttacagcagtgaacatgaacattcacttagcttcctcagtctctccatcttaaagatcatttatcagaggaggttcagcattttttgcagcataacttttcatgagtctgtattactaatggataagtcaaatccatcctgcacttctacagtttagaaagtatctggactcagaataaatgtaatatttatacttgtttccagaatgttattttacattttatgttcaataagaacactttttaaaagacgtatattcaacataaaatcagctatcagacttcagattagactttatttatgtgggtctataataattgtattttcaagaggttttcactatatttgtattggcctggttttctcagacgattttggacaaatcattagaaactgggcatcatatccacagttatgtaaggcagtgatatactataaggataaacaaagtcaagtccataaagcaataatccctcagaaggaaagtccttacttttcacatattaatatttagtaatttttcctgcttctaaaagtgagagtatcacaccctaaatgaacactgtctactaagagacatcattccatttccacaaatgaagattttattccaagaaacgagtttactgattggagcatagggcttgttgttatttttattcaagcttttagtaatagccttgaatttattatttttcttataggctttttgttaaaatagtgaaggaacaaatgttaaagggtaagataatttccctgcaaaaggacacagaaggcagtcttaagaagatgaatggatgagagaagggagagaataaaatgcaataacgagccagcatttactatgtattttctcctcacctgtctctccatatttaggtcacttaccagtttctgtgcccttttggagcttttgttgagggcttcattctcaccctgtatttctttagccctaaattgacactctctccaaaaatccattccattgtctgtggaccaagatgttctatgtaattcagaagcagaactcttggctaaagggctagtgtggccttcagaaaccattcaattattttctccctacacctttgtcagtttgaaaccagtgaggaaaaaaggtatgttgataagaaacctatattgctaggtagaatttgtacttgttttcttggtagcagttttgaaatattctgtacagtacgttcctattgtttaataataaattcaaaaatatttctaaaaccttaaaaccaactatgccaagcattaagataaacaaatatgatgttctttgacgtaaatcaacgtgatgattctttcacatgtaaacacattttagtgtttctggtttgtcatttttgttgttgttgttgttgttgttatttactctataccctttagcaaaatacagttttaaatttttattgtttttagtagtttcccaactttaagacttatctaatttaactgagaaagaaagcctttttcatatatatatatattggatttctaaggatggtggtttgagccttgattagacttttgatgtgctaagccagacaggcagtctgtacattgatggccatcacaatgcagctttggtttaatttaattcaggcctgctgctgagttatgcacagactttttgttgaccaaaataaaatataaagggttttcttctgtttgacatttgtgttcattttttctctttatgtattacattttaacctatattaaataaatgtttaaatgataatttgcttatgtcttataaaactcagcataagaaaaatactgccctaccttgactgtgtaatcttatttgataaagcctttgctattcattatttccattctgattaactgaaagagatttatagagatgctcaaattttaagcccttggtgcttttagatatatattggttgcaaaagtttggcattaatgatttccctctgcttatgtgtaaatgcctatgttccaaagctttgccactagatattcaaatcataaattgtcatgtaagccagtcttccagaaagaaaagctatttcagcaaaatgatatttcacatttagacaaaacagtagtatttagacaataatattttgacaaaaccattttcaaaactgcttaggaaaaaggggaaatattatacttaaaggtaatgacctctgtcttgaatagaggtgagtgggttggtgacaactggtttggaggcttttgtgggggactgtggtgtcttttggattgtgtcatcagctccttcatcaagtaagcgtgtagctgttattgcctattgtaaaacatgaattgatgtgaacagtactcaatctcttacattatatgaagtataacttcctctcttttttgcctataatacatcctttaacttttacagattaaaaaaccactgttagacaaagcaaaa

SEQ ID NO: 148299 - DNA, 986 bp, Homo sapiens
  Payload ID: 9362
  Gene Symbol: LZTFL1
  Gene Name: leucine zipper transcription factor-like 1
  ENST ID: ENST00000411866
  CDS Start-End: 168-347
gttagcaaccagaggcttctaaacaacctaccctccttccccattttctgtggtccaactaccctcggcgatcccaggcttggcggggcaccgcctggcctctcccgttcctttaggctgccgccgctgcctgccgccatggctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaaggaattagaaaagaaatttcagcaaacagcagcttatcgaaacatgaaagagattcttaccaagaagaatgaccaaatcaaagatctgaggaaaagactggcacaatatgaacctgaagattaaaactgaagatttcctctggaagctaccacatgcaaacatacaagcagtctcacctcaggcatgtattttgaaa

SEQ ID NO: 148300 - DNA, 1376 bp, Homo sapiens
  Payload ID: 9362
  Gene Symbol: LZTFL1
  Gene Name: leucine zipper transcription factor-like 1
  ENST ID: ENST00000448111
  CDS Start-End: 107-433
acacctcccaccatgctggcactgaggttatctaagagttgacagccccatctaaagccttgaatgaattaagtcttttttagctaaaaaatgaacaaaacctgagatgcatgagtgtccttaccaaaaggaagtccttgtttctaggacaggtctgtcttcgggcctgtgggtccatagaatcatcacagaaaaaatgatttcaggaggtctcccccgctttctgctcccaaggccgactctgactgagcctcggaggagagaaggaagccatttctgggaggccaaaacgtccgtcttccaggctcttgctgtaagtcagcccacttttacagatgaggaaccaagacccagggaagatgggaaggcagagaaaatccatcaagttgtaccctacccaccctttggtgacttttccaagaagctgggctaagttccaggagaaagctctgctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaagatatgaacctgaagattaaaactgaagatttcctctggaagctaccacatgcaaacatacaagcagtctcacctcaggcatgtattttgaaaagcattttgtcatatcccctctccttatttttctaatatttagactttgaatatttagaactagagttcctattttcagctagttgaaaacagagaaaacctagtgattctgtctggtcatcccacacacctctctactgagtgctccagagtcttagctcacatgcactgagaattctttaca

SEQ ID NO: 148301 - DNA, 444 bp, Homo sapiens
  Payload ID: 9362
  Gene Symbol: LZTFL1
  Gene Name: leucine zipper transcription factor-like 1
  ENST ID: ENST00000445698
  CDS Start-End: 173-444
ggcttctaaacaacctaccctccttccccattttctgtggtccaactaccctcggcgatcccaggcttggcggggcaccgcctggcctctcccgttcctttaggctgccgccgctgcctgccgccatgagttgggcctaaatgagcaccatcaaaatgaagttattaattatatgcgttttgctcgttcaaagagaggcttgagactcaaaactgtagattcctgcttccaagacctcaaggagagcaggctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccg

SEQ ID NO: 148302 - DNA, 718 bp, Homo sapiens
  Payload ID: 9362
  Gene Symbol: LZTFL1
  Gene Name: leucine zipper transcription factor-like 1
  ENST ID: ENST00000440576
  CDS Start-End: 1-706
gctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaaggaattagaaaagaaatttcagcaaacagcagcttatcgaaacatgaaagagattcttaccaagaagaatgaccaaatcaaagatctgaggaaaagactggcacaatatgaacctgaagattaaaactgaagattt

SEQ ID NO: 148303 - DNA, 2014 bp, Homo sapiens
  Payload ID: 9362
  Gene Symbol: LZTFL1
  Gene Name: leucine zipper transcription factor-like 1
  ENST ID: ENST00000418700
  CDS Start-End: 425-751
acacacatctgaagagcaaacagatggtgaaaccagtagcccaagatgagaaaacggactttttttgagacagcagttgaagctgaagcctcaaaagccgggcggggggaaagcatagcaattatgaaagacattcaaagtgggttaggggtgagggaaaggtcagccttttacttttcccacacccgctgttttctgaagaaggatggtaatgcgagcagaagggtgatggccaacctctgggctttgatgtgtgtcccctcctcccgcccccatcctgcaagctctggggaggtcggagactagtgtggtttcctcacacctcccaccatgctggcactgaggttatctaagagttgacagccccatctaaagccttgaatgaattaagtcttttttagctaaaaaatgaacaaaacctgagatgcatgagtgtccttaccaaaaggaagtccttgtttctaggacaggtctgtcttcgggcctgtgggtccatagaatcatcacagaaaaaatgatttcaggaggtctcccccgctttctgctcccaaggccgactctgactgagcctcggaggagagaaggaagccatttctgggaggccaaaacgtccgtcttccaggctcttgctgtaagtcagcccacttttacagatgaggaaccaagacccagggaagatgggaaggcagagaaaatccatcaagttgtaccctacccaccctttggtgacttttccaagaagctgggctaagttccaggagaaagctctgcagagttgggcctaaatgagcaccatcaaaatgaagttattaattatatgcgttttgctcgttcaaagagaggcttgagactcaaaactgtagattcctgcttccaagacctcaaggagagcaggctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaaggaattagaaaagaaatttcagcaaacagcagcttatcgaaacatgaaagagattcttaccaagaagaatgaccaaatcaaagatctgaggaaaagactggcacaatatgaacctgaagattaaaactgaagatttcctctggaagctaccacatgcaaacatacaagcagtctcacctcaggcatgtattttgaaaagcattttgtcatatcccctctccttatttttctaatatttagactttgaatatttagaactagagttcctattttcagctagttgaaaacagagaaaacctagtgattctgtctggtcatcccacacacctctctactgagtgctccagagtcttagctcacatgcactgagaattctttacagcaaagaagagatttttagagtgggaagaagaggcttatccttctgcattagtataaagagtctgtatttttaataaatgttaaataagct

SEQ ID NO: 148304 - DNA, 4342 bp, Homo sapiens
  Payload ID: 9362
  Gene Symbol: LZTFL1
  Gene Name: leucine zipper transcription factor-like 1
  Uniprot ID: Q9NQ48
  ENST ID: ENST00000536047
  CDS Start-End: 500-1348
acacctcccaccatgctggcactgaggttatctaagagttgacagccccatctaaagccttgaatgaattaagtcttttttagctaaaaaatgaacaaaacctgagatgcatgagtgtccttaccaaaaggaagtccttgtttctaggacaggtctgtcttcgggcctgtgggtccatagaatcatcacagaaaaaatgatttcaggaggtctcccccgctttctgctcccaaggccgactctgactgagcctcggaggagagaaggaagccatttctgggaggccaaaacgtccgtcttccaggctcttgctgtaagtcagcccacttttacagatgaggaaccaagacccagggaagatgggaaggcagagaaaatccatcaagttgtaccctacccaccctttggtgacttttccaagaagctgggctaagttccaggagaaagctctgcagagttgggcctaaatgagcaccatcaaaatgaagttattaattatatgcgttttgctcgttcaaagagaggcttgagactcaaaactgtagattcctgcttccaagacctcaaggagagcaggctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaaggaattagaaaagaaatttcagcaaacagcagcttatcgaaacatgaaagagattcttaccaagaagaatgaccaaatcaaagatctgaggaaaagactggcacaatatgaacctgaagattaaaactgaagatttcctctggaagctaccacatgcaaacatacaagcagtctcacctcaggcatgtattttgaaaagcattttgtcatatcccctctccttatttttctaatatttagactttgaatatttagaactagagttcctattttcagctagttgaaaacagagaaaacctagtgattctgtctggtcatcccacacacctctctactgagtgctccagagtcttagctcacatgcactgagaattctttacagcaaagaagagatttttagagtgggaagaagaggcttatccttctgcattagtataaagagtctgtatttttaataaatgttaaataagctaacaatgtttgtacttatgcattccccatgggtaaaaataaataatagcattgttaaagatagttattaccaaaaaaagagagttattacaaataaatatgtctctttatttttaaaaatgaaatcttaattcatttactctatttgatgataaactataaattcattgaaaatgtgaattctattatgggtagcctttttaccaattataaggaaaatttacagcagtgaacatgaacattcacttagcttcctcagtctctccatcttaaagatcatttatcagaggaggttcagcattttttgcagcataacttttcatgagtctgtattactaatggataagtcaaatccatcctgcacttctacagtttagaaagtatctggactcagaataaatgtaatatttatacttgtttccagaatgttattttacattttatgttcaataagaacactttttaaaagacgtatattcaacataaaatcagctatcagacttcagattagactttatttatgtgggtctataataattgtattttcaagaggttttcactatatttgtattggcctggttttctcagacgattttggacaaatcattagaaactgggcatcatatccacagttatgtaaggcagtgatatactataaggataaacaaagtcaagtccataaagcaataatccctcagaaggaaagtccttacttttcacatattaatatttagtaatttttcctgcttctaaaagtgagagtatcacaccctaaatgaacactgtctactaagagacatcattccatttccacaaatgaagattttattccaagaaacgagtttactgattggagcatagggcttgttgttatttttattcaagcttttagtaatagccttgaatttattatttttcttataggctttttgttaaaatagtgaaggaacaaatgttaaagggtaagataatttccctgcaaaaggacacagaaggcagtcttaagaagatgaatggatgagagaagggagagaataaaatgcaataacgagccagcatttactatgtattttctcctcacctgtctctccatatttaggtcacttaccagtttctgtgcccttttggagcttttgttgagggcttcattctcaccctgtatttctttagccctaaattgacactctctccaaaaatccattccattgtctgtggaccaagatgttctatgtaattcagaagcagaactcttggctaaagggctagtgtggccttcagaaaccattcaattattttctccctacacctttgtcagtttgaaaccagtgaggaaaaaaggtatgttgataagaaacctatattgctaggtagaatttgtacttgttttcttggtagcagttttgaaatattctgtacagtacgttcctattgtttaataataaattcaaaaatatttctaaaaccttaaaaccaactatgccaagcattaagataaacaaatatgatgttctttgacgtaaatcaacgtgatgattctttcacatgtaaacacattttagtgtttctggtttgtcatttttgttgttgttgttgttgttgttatttactctataccctttagcaaaatacagttttaaatttttattgtttttagtagtttcccaactttaagacttatctaatttaactgagaaagaaagcctttttcatatatatatatattggatttctaaggatggtggtttgagccttgattagacttttgatgtgctaagccagacaggcagtctgtacattgatggccatcacaatgcagctttggtttaatttaattcaggcctgctgctgagttatgcacagactttttgttgaccaaaataaaatataaagggttttcttctgtttgacatttgtgttcattttttctctttatgtattacattttaacctatattaaataaatgtttaaatgataatttgcttatgtcttataaaactcagcataagaaaaatactgccctaccttgactgtgtaatcttatttgataaagcctttgctattcattatttccattctgattaactgaaagagatttatagagatgctcaaattttaagcccttggtgcttttagatatatattggttgcaaaagtttggcattaatgatttccctctgcttatgtgtaaatgcctatgttccaaagctttgccactagatattcaaatcataaattgtcatgtaagccagtcttccagaaagaaaagctatttcagcaaaatgatatttcacatttagacaaaacagtagtatttagacaataatattttgacaaaaccattttcaaaactgcttaggaaaaaggggaaatattatacttaaaggtaatgacctctgtcttgaatagaggtgagtgggttggtgacaactggtttggaggcttttgtgggggactgtggtgtcttttggattgtgtcatcagctccttcatcaagtaagcgtgtagctgttattgcctattgtaaaacatgaattgatgtgaacagtactcaatctcttacattatatgaagtataacttcctctcttttttgcctataatacatcctttaacttttacagattaaaaaaccactgttagacaaagc

SEQ ID NO: 148305 - DNA, 4113 bp, Homo sapiens
  Payload ID: 9362
  Gene Symbol: LZTFL1
  Gene Name: leucine zipper transcription factor-like 1
  Uniprot ID: Q9NQ48
  ENST ID: ENST00000539217
  CDS Start-End: 336-1106
acacctcccaccatgctggcactgaggttatctaagagttgacagccccatctaaagccttgaatgaattaagtcttttttagctaaaaaatgaacaaaacctgagatgcatgagtgtccttaccaaaaggaagtccttgtttctaggacaggtctgtcttcgggcctgtgggtccatagaatcatcacagaaaaaatgatttcaggaggtctcccccgctttctgctcccaaggccgactctgactgagcctcggaggagagaaggaagccatttctgggaggccaaaacgtccgtcttccaggctcttgctgtaagtcagcccacttttacagatgaggaaccaagacccagggaagatgggaaggcagagaaaatccatcaagttgtaccctacccaccctttggtgacttttccaagaagctgggctaagttccaggagaaagctctgctggtggaggacaccttcaccatagatgaagtctctgaagtcctcaatggattacaagctgtggttcatagtgaggtggaatctgagctcatcaacactgcctataccaatgtgttacttctgcgacagctgtttgcacaagctgagaagtggtatcttaagctacagacagacatctctgaacttgaaaaccgagaattattagaacaagttgcagaatttgaaaaagcagagattacatcttcaaacaaaaagcccatcttagatgtcacaaagccaaaacttgctccacttaatgaaggtggaacagcagaactcctaaacaaggaaattttaagacttcaagaagagaatgagaaattgaagtcaaggttgaagaccattgaaatacaggctacaaatgcactggatgaaaagtcaaaactagaaaaagcactgcaagatttacagcttgatcaaggaaatcaaaaggattttataaaggcccaagacttaagtaacttagaaaacactgtcgctgccttaaagagtgagtttcagaagacacttaatgacaagacagaaaaccagaagtcactggaggagaatctggcgacagccaagcacgatctactcagggttcaggagcagctgcacatggctgaaaagatatgaacctgaagattaaaactgaagatttcctctggaagctaccacatgcaaacatacaagcagtctcacctcaggcatgtattttgaaaagcattttgtcatatcccctctccttatttttctaatatttagactttgaatatttagaactagagttcctattttcagctagttgaaaacagagaaaacctagtgattctgtctggtcatcccacacacctctctactgagtgctccagagtcttagctcacatgcactgagaattctttacagcaaagaagagatttttagagtgggaagaagaggcttatccttctgcattagtataaagagtctgtatttttaataaatgttaaataagctaacaatgtttgtacttatgcattccccatgggtaaaaataaataatagcattgttaaagatagttattaccaaaaaaagagagttattacaaataaatatgtctctttatttttaaaaatgaaatcttaattcatttactctatttgatgataaactataaattcattgaaaatgtgaattctattatgggtagcctttttaccaattataaggaaaatttacagcagtgaacatgaacattcacttagcttcctcagtctctccatcttaaagatcatttatcagaggaggttcagcattttttgcagcataacttttcatgagtctgtattactaatggataagtcaaatccatcctgcacttctacagtttagaaagtatctggactcagaataaatgtaatatttatacttgtttccagaatgttattttacattttatgttcaataagaacactttttaaaagacgtatattcaacataaaatcagctatcagacttcagattagactttatttatgtgggtctataataattgtattttcaagaggttttcactatatttgtattggcctggttttctcagacgattttggacaaatcattagaaactgggcatcatatccacagttatgtaaggcagtgatatactataaggataaacaaagtcaagtccataaagcaataatccctcagaaggaaagtccttacttttcacatattaatatttagtaatttttcctgcttctaaaagtgagagtatcacaccctaaatgaacactgtctactaagagacatcattccatttccacaaatgaagattttattccaagaaacgagtttactgattggagcatagggcttgttgttatttttattcaagcttttagtaatagccttgaatttattatttttcttataggctttttgttaaaatagtgaaggaacaaatgttaaagggtaagataatttccctgcaaaaggacacagaaggcagtcttaagaagatgaatggatgagagaagggagagaataaaatgcaataacgagccagcatttactatgtattttctcctcacctgtctctccatatttaggtcacttaccagtttctgtgcccttttggagcttttgttgagggcttcattctcaccctgtatttctttagccctaaattgacactctctccaaaaatccattccattgtctgtggaccaagatgttctatgtaattcagaagcagaactcttggctaaagggctagtgtggccttcagaaaccattcaattattttctccctacacctttgtcagtttgaaaccagtgaggaaaaaaggtatgttgataagaaacctatattgctaggtagaatttgtacttgttttcttggtagcagttttgaaatattctgtacagtacgttcctattgtttaataataaattcaaaaatatttctaaaaccttaaaaccaactatgccaagcattaagataaacaaatatgatgttctttgacgtaaatcaacgtgatgattctttcacatgtaaacacattttagtgtttctggtttgtcatttttgttgttgttgttgttgttgttatttactctataccctttagcaaaatacagttttaaatttttattgtttttagtagtttcccaactttaagacttatctaatttaactgagaaagaaagcctttttcatatatatatatattggatttctaaggatggtggtttgagccttgattagacttttgatgtgctaagccagacaggcagtctgtacattgatggccatcacaatgcagctttggtttaatttaattcaggcctgctgctgagttatgcacagactttttgttgaccaaaataaaatataaagggttttcttctgtttgacatttgtgttcattttttctctttatgtattacattttaacctatattaaataaatgtttaaatgataatttgcttatgtcttataaaactcagcataagaaaaatactgccctaccttgactgtgtaatcttatttgataaagcctttgctattcattatttccattctgattaactgaaagagatttatagagatgctcaaattttaagcccttggtgcttttagatatatattggttgcaaaagtttggcattaatgatttccctctgcttatgtgtaaatgcctatgttccaaagctttgccactagatattcaaatcataaattgtcatgtaagccagtcttccagaaagaaaagctatttcagcaaaatgatatttcacatttagacaaaacagtagtatttagacaataatattttgacaaaaccattttcaaaactgcttaggaaaaaggggaaatattatacttaaaggtaatgacctctgtcttgaatagaggtgagtgggttggtgacaactggtttggaggcttttgtgggggactgtggtgtcttttggattgtgtcatcagctccttcatcaagtaagcgtgtagctgttattgcctattgtaaaacatgaattgatgtgaacagtactcaatctcttacattatatgaagtataacttcctctcttttttgcctataatacatcctttaacttttacagattaaaaaaccactgttagacaaagc

SEQ ID NO: 148306 - DNA, 1381 bp, Homo sapiens
  Payload ID: 9363
  Gene Symbol: LDOC1
  Gene Name: leucine zipper, down-regulated in cancer 1
  Uniprot ID: O95751
  ENST ID: ENST00000370526
  CDS Start-End: 105-545
ctggccaccaagcgcctccgtggacacgcacttcctgcgagggctccgtgcgcaccttggccgagccgaaccgagccgagtcctgtccttccaggccgttcgcaatggtggatgagttggtgctgctgctgcacgcgctcctgatgcggcaccgcgccctgagcatcgagaacagccagctcatggaacagctgcggctgctggtgtgcgagagggccagcctgctgcgccaggtacgtccgccgagctgcccggtgcccttccccgaaacgtttaatggcgagagctcccggctccccgagtttatcgtgcagacggcgtcttacatgctcgtgaacgagaaccgattctgcaacgacgccatgaaggtggcattcctaatcagcctcctcaccggggaagccgaggagtgggtggtgccctacatcgagatggatagccccatcctaggtgattaccgggccttcctcgatgagatgaaacagtgctttggctgggatgacgacgaagacgacgacgacgaagaagaggaggatgattattaggccctcgaccctcgggcctcgggggggagggccctgcacgccgccaccccctccccgcagccctcaccccgccaggagccactgctctcccccttgccctccggtccccttacctacccgcgcccgtctgctctctctcttcatttctccgtagtgcttgtctttgttccaggaatagcgctccagttacctgctgctggggtcggggctggagcctcactcactcggaagtgcttggaagtgtcatctaccctggccatccccgggatccctcccctgctaatctgaactgtgtcctgaaccccagctattggccaggcccctgttacaaactgcgcagaccacccgtagccctgctgctgccacctgccctgctgccaggcttacatcttcccagagaactatgctgccacttcacatccactcaccacatcccacctacagactaccacctttcgagatcaggaccaacctggaaaatgccagagttggctatgccttttcagacattgatttggacagctcaccaacccctgaaggggccgttcagcctggttagttttctacctactccgagtgtcctcccctgccccaccagattgctgcaggggcgcggtgtgcctggcagccaaattgttgacacttcttttttcctatgcactggttttacacagctgtcatttttctttcaaaattgcagcagtcccacagatgtgtgcatttggacaaatagtacttaaaaacaaaacaaacaagcactcagcccagctcctcaatactacctggaaaaagcattggcattattttcaataaatatcaagcactaaaaaaagaaa

SEQ ID NO: 148307 - DNA, 5495 bp, Homo sapiens
  Payload ID: 9364
  Gene Symbol: LDOC1L
  Gene Name: leucine zipper, down-regulated in cancer 1-like
  Uniprot ID: Q6ICC9
  ENST ID: ENST00000341255
  CDS Start-End: 511-1230
acaaaggccgcgcggtgacccgccctctgccgcgaccccggccccgcccctgccccggccccggcctggcccggtccctgcacctgccggaggccgcccgccgccatcgccagcgccgtcgcttggctgcgctgaccgggaagcagttctcggcggtccgcgcggtgattcatcggcctggccgcgtcccccgcgcgggccatcttggtcacggccggcggcggacagagccgcggaggaaccgcgagaccccagggcccagagcaggtccagccacccgtctggctccgtagtccgcgaagtctgcagtaaaggagccgcgtgggaccggggccgaagtccctagggcctggcaccgcgtgcccctctctcgggccctcggcttgggggtctcgcagcgccctgccgtcgtgcaccccacactgcccccatttctacaggggcccacctggtcaccacaccctcttggtccacccgcggatctcagcgtgtggctgacctctggccagcatggtgcagccgcagacgtccaaagctgaaagcccagccttggcagcgtctccgaatgcccagatggatgacgttattgacaccctgacctccctgcgcctcaccaactcggcgctgaggcgggaggcttccaccctgcgggcggagaaggccaatctcaccaacatgctggagagcgtgatggcagagctgaccttgttacgcaccagggcgcggatcccgggggctctgcagatcaccccgcccatctcctcaattacttcaaacgggactcgacccatgaccacacctccaacctctctgcccgagcccttttccggggacccaggccggttggcggggttcctgatgcagatggacagattcatgatcttccaggcctcccgcttcccgggtgaggccgagcgtgtggccttccttgtgtctcgactgactggggaggcggagaagtgggctatcccccacatgcaacctgacagccccttgcgcaacaactatcaggggttcctggcagagttgcggagaacctacaagtctccgctccggcatgcgcggcgcgcccaaatcaggaagacttctgcctctaatagggctgtgcgagagaggcagatgctctgccgccagctggcctctgcgggcacggggccttgcccagtgcatccagcttccaacgggactagtccagcgccagccctgcctgcccgagcacggaatctttaagaatccgccagcacttggtagcgtctgcagccacccaggtagcatacgctctttgctgtgtagaagaaatgcccatacgacagctttgcccctgtttgaagacctcccttcttgcctctccagacgtgttccccgaggagatcttccttccgtccttcctggcgccctggttgcccaccttgccgtgcttcctcttacgtgctagctttgtacctatcgctcactgcatgctcgcctccctcttgctggcatcccggcctgtttcaatgactaccgctctgctacttaggcacagggactccgccgcacgctgacggaccacgagggctgaccccttccagcctgacttggttcatggaggctcctactctgccctctccaagctcccctggcggctccccacctggttgcccagttcctattgatgagctctggacagaaagatgcccgtttggccaggctggtggcttgatgggtgtacctggagagggggtctggcttcctgcccaagatgcctcccagccctgccagggcccggtgcagcgggcagggcctcatctgtgctgtagtggtcgagtggttgctgcaaggagcgtagttctgccatgtctgggggccaggttccactctgcacatgaatatgcagtctgggaggccccactgctctcactgggaaggaccaatgttgcacctctgttaatgcctgacttcagctgctggtgttctgatggagccagaggcttggggaatctggaacttgcctgctaaataaggtcgtggtggactctcagccattgggcaggtctatcaggctgcaggttcctacacacccacgcctgagggtcatagcaggctaagggtggataccagcgactccctttgctgcccaggatctccatgggcagtgccacagcggctgatgctcagtcactcctgcttctaccccctgtcactgatggcgagccttgcccagcttgagacctgttcccatctctattcaggtgccatgtggccttcactgcagccctgcagccacccacgcaccatctgtgggtctccaaaggcaccttgtagcatgtactccccgtgcctgggcaatcagatgggctgcctttgtccaagggaaaacagactcccttcgggaaacatccttaagcacttaaggccggggggggtgtctgcctctggcaacccagccagggtcttggtggcatttgtaaaagcaaagagctgtggactgccgtggtcctagtgtggtgacaatgcagcactggcatgcatgtcctccttctgaaggacctcatccttcctcacagggggatgaccaagaaatcattttgtggctgagtttggccacgccctttggactgtgctgttccgccatatttcaatgccaaatgaaccacattgacatgacctggaccatagggcttcctatcctgggctcagctgcccctgtctgaagggtcttggcttgattgcagaaggacaacctccgcacccacctaaagacatgtatatgtcttgggatcccagagattgggtccttgggcctggcttcttaagagttttgatgatgctgggaaaagtgactgcgattctgaagaaccgctgccttgcaaggtcaaggacattcagtggttgctggggtccgcagactactgccacccactcaccatcaactctgttagcccaattgccctgctgaacaactgcctgaatacaggctttaggttcccctggactccagccaaggctgttcaggtgggaccatggtgctctttaagcgtgatcggagggaagacacacagcagggccaccattccatgaatgggaggtgtacagatcactttctctttgtgctcagttctgttctgtctccagcagctatattggtaagactagtacctgccagggagaggtgcccccaagtgaaggggtacagtggcacctgggaaaaggcacctggaaggtttccatgtggcccagcccagcatggaagcagggtgggaactctgctgtgtcgccagcgctcactctactcgagtggctttttgaaagccctaccatgtctgtgtcaggcctgtgctgcttcacatcctacagctgcctaggaaaggccggccacgctccctgtccacacactccctgtccacacactccctgtccacacactccctgtccacaactgcagccgggccctctgcctatgggcacccaatccaagcagctgctccacctttgtttggcatggtgatttgtgttttttctcttggtgcttatgtgtgtgggcttgggacgagtgctggtatgcacttaggaccttcttgatagctccctgcactttggaacacggagcagatgagagagggtcggggcttgccctccaccttggacttggaagaagcccacattggagaggtgaggaccccatggtggctctagtggaagatacgttagtctccagctaaggaggatgaggcgcagccccagagggagacctcagtgataggggatcaggctaagaaagtgggggaagggagatgctttgtacatattttggggttataatttctctaaattttaggagaacgggtattgattgataaaagggacaggcagtagtgttcaacagtgcatgtgaaggaaagttctgttttccatggttttgacattctttggactgtattgtgactgctgtctggtccacatggtacccctttggtaagtaggcttcagtgcataccagggtatcactggagatgggagttagtgaaggggtgactccctggcctagtatagtgtgaccctgggactaacttaatgtcctaaagcattttggtgacttctagggaatagcaaagacctatttcattgtccccaggtaagtatgtgatgagcaatgaggaggagtggaaaacaaaacccagaaagtgcggcaggaccagcctgacgcacacgctcctgttgtcatggcagacagccgccttgggtgggcaccaccctggcagttccagcctgtaggggagtgaagggacatggctgagctgggcatgtgctgaggttgacttagggaacaagccctgggattggacaaaagggcccatgctgcagccactgactgggggcagagctctgggtggaagagggaagagatcctaatggaggcgcctccatctgcaaccacagttgtaaggctcatggcacctctgcttggaaagcactggtttagggacttagagaggtaggcacaaggtgggtctcctgggtaagggaagcaagagcagactgttgggccaacaggagaagctccccagagtaggggagaaggttggggtgtagggccttccacgtggaacagacagcccctgtgtctctgtctcttggggacctgagtttgggtggggtggcagttggcacagcgcagatgcggtagagatgggaggaaacccagctcctcacttccgtgtgcctcatgcctttgcatacacaagcaccaaacctactaggtcttctcattacccatgtaaaccacatgttagataaatttttgcaagtagaggaaagaaggaaataaaacatcacattttggtgtctctcaggctttcccccccaactatggtttctttgctttttgttttaacatagttttgttgctgtcttctgtaatgatacagttttgtgcagctgttttcacttagcatatcgtgggcatctccccttatgattactaaatattttattttggagtggctgtgtactctcccattgactagatggaccattgtgccagttgccaatcactaatgctgttactaacttttcagttataaattgatgaatatctttgtgcacaggctgtttcccaatgtcaagttattagggtagactccaggaggtgggattcttcaactaaagaatatgaaaacctttgaggcttttactacatattgacaaaatggtttccggaaatatttgtatccccttacactgccaccagcaaggataaacatgtccatcttgcccgtattgggaattatcatctggctaaatatttgctaatttgataatgaaaaaatagcatcgtgtttcagttggcatttcactgacttctagcacggttgaacatctttcatgtggagcgattgtatttcctcctttgtggattgtcagtgtcctttgctctatcttctggggtcagataaatttgtatgagctcggtatatattaaagatattaacctggtgtgtgtcatatttgctaca

SEQ ID NO: 148308 - DNA, 5459 bp, Homo sapiens
  Payload ID: 9365
  Gene Symbol: LZTS1
  Gene Name: leucine zipper, putative tumor suppressor 1
  Uniprot ID: Q9Y250
  ENST ID: ENST00000265801
  CDS Start-End: 112-1902
tgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaaggtgaacctgctggagcaggagctgcaggagctgcgggcccaggccgccctggcccgcgacatggggccgcccaccttccccgaggacgtccctgccctgcagcgggagctggagcggctgcgggccgagctgcgggaggagcggcaaggccatgaccagatgtcctcgggcttccagcatgagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctctgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagatatcctctccccctcctccagggaaggtggccacagcaagtacagcggctcccctctgcttctcatcccaacctctttttcctcctggacacattggaatgccttggaaatagaaagaagccatatatgaccagaagccttggaaccagccccatcagaacctgagctattttcctctggccgcagaggtgtaggggtggaatgagccgcggggaagctggctttgaaacctcagggctgtcccagccccggcaagccacaggaaggaggggagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccaggcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtcccagactaaaggatccagagagcagctccctttctcaggagcttgggcagtgccccagggagtccagggtttctctgcagatgtgcggagcgggaggcggtggtagagagagataaaaggtggagtttctctgttgtttggttcagggattttatttttaattttatgagacagggtcttgctctgtcccccaggctggagtgcagtggcatgatcatagctcactgcagcctcatactcctgggctcaagcaatcctcctgcctcagccttccaactagctgggactacaggtgcgcgccaccgtgcctggctaacttttcattttttttgtagggacggggtctcgttttgttgccaaagctggtctcaaacttgtggcctcaagcaatccacctgccttggcctcccaaagtgctgagattgcagatgtgagccaccgtgcctggccagatttttcttttattcttctttctttttcttttttgctttcttgtcttttcagaagcaagccagacctagcaggctgttccatgttctatttttgactgtagccacagctgctgttctcaggacagcatcccttcccacatgcctgcgcctgctgcctgctgagatgaggaggggagcgtctgggaacttgcgagtccaaggccagtccccatttctgcctcgctcaccgctggcccttagagaccccgaggtaggggtggggagatgcttctctccttgccccccgccctcatgggtcctagcccttccctgagtgcgggctgaggccagagtcaccttttctgtggctggctctaccttcctgtccctgaggttaaacggtgcccatcctgccatcctcaaacgacagaggagcttttctggaatttcaaaccattgctcttagtcccaagctaggcttaaacctggaatctacaagccaaaagtccctccctgcctgagggcagtaccctccattgggcacagtccagacccaagtcaaagatgccccattccttgcgcctcagccctcagttccttcatttccaccaggccgtgccttgtttgagtttttcctcccagtgagactgccccacggagacagaggaaagggctggctccccctccccaggctggagacccccccccaactccaggaaagagcagtcagagtccagtgctctgcctcagacgttgcctgagaagaagtggctgccacacccaggggaaggccctgaggcggaggctgtgctccgccatggtgtcccggtaccttccatacacagaggagtgcagccttctccatatctccatggccctgtcccaggccggcccagatgtgtcccccccaggccttgtcctacgtccaaggtggcagatgtcttccctgggctgccaccagcccccgccccagagtggcccaccgtggcactagaatgcaagtatcctgcgaccttgcaacctcaccttcctgtgggtgttctttcctgccctgtccaaaagcgccctcactattcttggaccatgccagattctgcctctctggaaagaggctctggacagcagaagcctccaagcacagagcctggccccaggccccagacagggtgggcttcctgcccttccctctgggcacgcctgctggccgacccactgacccactcggatggaccaacctgctctgtccccaaaggacgcctgcaggagagagcagcactccgcatcacctcaccaaggatcggactctgcccctggacctgggaacgactggactgtcacggggttccctcctagctctcccagtgaactcctgccaggcacacacagcccctatagcactgagctcacatgggactgggatatgggggcatctcttccccagagaggcactcagtgagcctcctgtgcctggccccagcctgggccatctcttaggtgagacagttgcccgaaactaagccaggcctggctggaggagcagcagcttggggagagggatttccctgcagacctcaagccatcatgcggtgggtgctgccatgacagaggctgcacccctgggccagcggggctgctcacccacctcttgtgcaaggtggcctttgtgctgcgcctgcaggcagagctggagcccccagcagaggcaggctgggacggaccagcatctggaagatgtacatagttatttttctctttgtggtttcttgtttggtttggtttgcttttgacagcttcattttatttttgacgtcactttttggccatgtaaactatttgtggcaattttatgtttttatttatgaataaagaatgccatttctcacgccctcta

SEQ ID NO: 148309 - DNA, 5706 bp, Homo sapiens
  Payload ID: 9365
  Gene Symbol: LZTS1
  Gene Name: leucine zipper, putative tumor suppressor 1
  Uniprot ID: Q9Y250
  ENST ID: ENST00000381569
  CDS Start-End: 359-2149
gcagaggccggcgcgcctggagctggcgggttggcagcggccgggcggggaggccgaaagtttctctgcccgcctcggccagtgagtgggagccgggagctgcatcccgcgcagtgggaccggcccggcccgctcagcagctctggaaaaagagagacgggaacacaccgggaaacactgggaaaaaaaaaaagtctcaagtgcgcccgaggcgcagggggcaggtctacggctctcgcaggctctgtgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaaggtgaacctgctggagcaggagctgcaggagctgcgggcccaggccgccctggcccgcgacatggggccgcccaccttccccgaggacgtccctgccctgcagcgggagctggagcggctgcgggccgagctgcgggaggagcggcaaggccatgaccagatgtcctcgggcttccagcatgagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctctgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagatatcctctccccctcctccagggaaggtggccacagcaagtacagcggctcccctctgcttctcatcccaacctctttttcctcctggacacattggaatgccttggaaatagaaagaagccatatatgaccagaagccttggaaccagccccatcagaacctgagctattttcctctggccgcagaggtgtaggggtggaatgagccgcggggaagctggctttgaaacctcagggctgtcccagccccggcaagccacaggaaggaggggagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccaggcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtcccagactaaaggatccagagagcagctccctttctcaggagcttgggcagtgccccagggagtccagggtttctctgcagatgtgcggagcgggaggcggtggtagagagagataaaaggtggagtttctctgttgtttggttcagggattttatttttaattttatgagacagggtcttgctctgtcccccaggctggagtgcagtggcatgatcatagctcactgcagcctcatactcctgggctcaagcaatcctcctgcctcagccttccaactagctgggactacaggtgcgcgccaccgtgcctggctaacttttcattttttttgtagggacggggtctcgttttgttgccaaagctggtctcaaacttgtggcctcaagcaatccacctgccttggcctcccaaagtgctgagattgcagatgtgagccaccgtgcctggccagatttttcttttattcttctttctttttcttttttgctttcttgtcttttcagaagcaagccagacctagcaggctgttccatgttctatttttgactgtagccacagctgctgttctcaggacagcatcccttcccacatgcctgcgcctgctgcctgctgagatgaggaggggagcgtctgggaacttgcgagtccaaggccagtccccatttctgcctcgctcaccgctggcccttagagaccccgaggtaggggtggggagatgcttctctccttgccccccgccctcatgggtcctagcccttccctgagtgcgggctgaggccagagtcaccttttctgtggctggctctaccttcctgtccctgaggttaaacggtgcccatcctgccatcctcaaacgacagaggagcttttctggaatttcaaaccattgctcttagtcccaagctaggcttaaacctggaatctacaagccaaaagtccctccctgcctgagggcagtaccctccattgggcacagtccagacccaagtcaaagatgccccattccttgcgcctcagccctcagttccttcatttccaccaggccgtgccttgtttgagtttttcctcccagtgagactgccccacggagacagaggaaagggctggctccccctccccaggctggagacccccccccaactccaggaaagagcagtcagagtccagtgctctgcctcagacgttgcctgagaagaagtggctgccacacccaggggaaggccctgaggcggaggctgtgctccgccatggtgtcccggtaccttccatacacagaggagtgcagccttctccatatctccatggccctgtcccaggccggcccagatgtgtcccccccaggccttgtcctacgtccaaggtggcagatgtcttccctgggctgccaccagcccccgccccagagtggcccaccgtggcactagaatgcaagtatcctgcgaccttgcaacctcaccttcctgtgggtgttctttcctgccctgtccaaaagcgccctcactattcttggaccatgccagattctgcctctctggaaagaggctctggacagcagaagcctccaagcacagagcctggccccaggccccagacagggtgggcttcctgcccttccctctgggcacgcctgctggccgacccactgacccactcggatggaccaacctgctctgtccccaaaggacgcctgcaggagagagcagcactccgcatcacctcaccaaggatcggactctgcccctggacctgggaacgactggactgtcacggggttccctcctagctctcccagtgaactcctgccaggcacacacagcccctatagcactgagctcacatgggactgggatatgggggcatctcttccccagagaggcactcagtgagcctcctgtgcctggccccagcctgggccatctcttaggtgagacagttgcccgaaactaagccaggcctggctggaggagcagcagcttggggagagggatttccctgcagacctcaagccatcatgcggtgggtgctgccatgacagaggctgcacccctgggccagcggggctgctcacccacctcttgtgcaaggtggcctttgtgctgcgcctgcaggcagagctggagcccccagcagaggcaggctgggacggaccagcatctggaagatgtacatagttatttttctctttgtggtttcttgtttggtttggtttgcttttgacagcttcattttatttttgacgtcactttttggccatgtaaactatttgtggcaattttatgtttttatttatgaataaagaatgccatttctcacgccctcta

SEQ ID NO: 148310 - DNA, 1614 bp, Homo sapiens
  Payload ID: 9365
  Gene Symbol: LZTS1
  Gene Name: leucine zipper, putative tumor suppressor 1
  Uniprot ID: Q9Y250
  ENST ID: ENST00000522290
  CDS Start-End: 1-1614
atgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaagcatgagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctga

SEQ ID NO: 148311 - DNA, 231 bp, Homo sapiens
  Payload ID: 9365
  Gene Symbol: LZTS1
  Gene Name: leucine zipper, putative tumor suppressor 1
  Uniprot ID: Q9Y250
  ENST ID: ENST00000616228
  CDS Start-End: 1-231
atgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaaggccatgaccagatgtcctcgggcttccagcatgagcggctcgtgtggaaggaggagaaggagaaggtga

SEQ ID NO: 148312 - DNA, 5741 bp, Homo sapiens
  Payload ID: 9366
  Gene Symbol: LZTS2
  Gene Name: leucine zipper, putative tumor suppressor 2
  Uniprot ID: Q9BRK4
  ENST ID: ENST00000370220
  CDS Start-End: 3064-5073
gcggccgccgccgcgccgtggccctttgtgctggaacaatgaccagctgccgctggccccggggccccggctggggttgagggtgaccaccgccgccgccgcgtcgagccgaaccgagcccccagacacgcagtcacagggcgtcggagggagggctcccgactgccgccgagcagcccctacgtgcgccccggcggattcgcgtgacgcgggtgcttgcgcgtgtccgcgccccggggcggagacgcccctcggaccctcccctgcgcggtgccgcccactcgcaccgggcgggggctggccagggccgggggcgccgcggaggcggaggcggggctgggccgggcagctccgagtggcggcgcgcgggccagggccggggccggggccggggccggagccggagccggggccgggcggcgcgcctgtggagcgctgggggcggcctggggctgagcatggagcagcgcggcggaggtgaggggggccgggtctgggaggcggcctggggagcccccaacttatgcgcggtggaatccagccggggggacggcgttccccagtcgcccccactttctggaaggggggctggactctggagaatgggtcaggggctcctggcttcccgccgcagaatgggaactcgtgatcgcagacttgaccccgcttgactggtccttggagtttgggtgggagggagactttccccaactcttcagatccgtctccggccctgaaccagctccagccctctgctctcctcagcccactaaaaggggggtgctcctgggccagagtgattgctcagggagtgctggggagaatgaggggttcccatctcccacagccacaaacgcatttctcaaaatggagcctccacttgcccctccttctctttcgggctccaagagcgggagccggcctggctgggcctggctttccagactcctggctctggctccctggatgtgtggctctcagggcccggctctgtggcactttggacttatgggccctcggctccgtggggttggggggccctggctcactgggtcccgctggctgtccccttgtcggcctgaccctcgggcctctccgagtctttgtctcttttgggtccctgtctttctctgagcctgtctccttccttcaattttcactttctccgtgctcgctgaagtggggaaatgcaacagaggtgccagcccccttggccccctaagaagtcccttccccactgttcactccacaccctggagtgggcccagagaggggaggggagggggttctctatctgctctgctgggggctggggtgtgtggggtggtctgagccccagccctacagaggggcctgtggtcactccctgctcctggcctacccctcccccagctccccgcagctcctgccccagcgtggacacctcttcctggttcgcagtgtcttttgacttgggtgggaaggagggcggtggatttaatggagggcatgcgagaaagaaggggaacagatcaggcaaaggagttagataatgtcccacctctccccacacgccgaagagagaaggaaacaggctccccccaccaatgggccctcaagccacccaggctcccaccactctcatacctgcgtgcccacgttcacaggctccactgcaccactcaccttcctagtcacacacaaacacaggagctcacacataaactcatgaacttactgacaagtctgtccaggcaccgtctctcccacacaccacaaattcacttgttagatccacatttataactttcacaggctttctaatgacccctgatccacatactcttctaagatatacacatgtgaattcacacatgaactcatatgtatgtgaatgaactgatatatcaaacatgcatagactcacatgatgttttcacacacattttcatacacacgtgttcattttcatgctcctgtgcatgtagtcacacaacaaataactaaatgcacacactcctactcccagtgcaattctctgtccacttcttggccccgctctgcatgatgacttcagcagatgcctaagtcctggtcatcagcggcctcgggactgggactagggagggggttccgggtggaggcttgcagctgcttccaggaaggagcagagcctggggaggtggagccctcttgcctgggctctgtggaagtgaggttttggagcagcctccagaggtgaaggcagggcatctaccttcctcccctcagggttagtttggggaccttctgaagctgtagggtttcagagaggttggcagtggggcagagcctgtggaggctccttcaggccttcaggcctcaccgattgggtgtgcagaggctaggagttgtcatggaaactggtatgagcctgcatccacctctgggaggcaggagaccccaaaggacacctgtggactccctaagagccgcgggtttcttatttagccagatcgacagagaggcagtttagccgcctttctgtctgagagaaactgaggcccagcagagggaggcagggcactgcctggccttggctctttgttccctaattaccatctgaggtgctgattgcacccctgaggtacctctgcccaaactgccctgtaatgaggccacctggctgagaggaccagggacctgtgcttcaagctggtagagaaggcccctccctcacctgagtcctggcctctgtggaggatgcaggattgggcttgggcctgggtctttgctgccaggtggccctgcggtaatcatccaggcctcccatgcctctcagcatctctgctgagtgaattcactcctcagccctgttcagaccagcattgggcagtgtggtttggggcccagggggaattgagattcattccagcacttgaagggggagtcttggtggggatcagggcttgttactgatgtcaaggaggtgtttggtcaggatcagtgggtcaggaggggtctcaaggtggagggactctgacaccactgccctgcttacaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaataa

SEQ ID NO: 148313 - DNA, 2883 bp, Homo sapiens
  Payload ID: 9366
  Gene Symbol: LZTS2
  Gene Name: leucine zipper, putative tumor suppressor 2
  Uniprot ID: Q9BRK4
  ENST ID: ENST00000370223
  CDS Start-End: 206-2215
ccaggtcgggccaggcgggcgccgggagctgggagccgggagcccagagttcggaacctagagttcggagccggctagggagccggcgttgtcgcggcgaggaggtgggcgcgctggagcaggagcggggccggaactggagccgaggcgcaggtggcgctgggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggcatacgaggagcggcagcggcactggcagcgagagcgtgaggccctgcgagaggactgtgcggcccaggcacagcgggcacagcgggcccaacagctgctgcagctgcaggtgttccagctgcagcaggagaagcggcaattgcaggacgacttcgcacagctgctgcaggagcgcgaacagctggagcggcgctgcgccaccttggagcgggagcagcgggagctcgggccgaggcttgaggagaccaagtgggaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccgagctcgggagctggagctggaagcctgttcccaggagctgcagcgacaccgccaggaagctgagcagctgcgggagaaagctgggcagttggatgctgaggcggccggactccgggagccccctgtgccacctgccaccgctgacccattcctcctggcagagagtgatgaggccaaagtgcagcgggcagcagccggggttgggggcagcttgcgggcccaggtggagcgattgcgggtggagctgcagcgggagcggcggcggggtgaggagcagcgggacagctttgagggggagcggctggcctggcaggcagagaaggagcaggtgatccgctaccagaagcagctgcagcacaactacatccagatgtaccggcgcaaccggcagctagagcaggagctgcagcagctcagcctggagctggaggcccgggagctcgctgacctgggcctggccgagcaggccccctgcatctgcctggaggagatcactgctactgagatctagggccctcagcaaccagctctgtagggagctctgccagaggggcagcagctgcagatccacttaggccccagggtccacggatggccccaaaggctgagggccccaaagccacttgtctcctaggatccaggcctctgggcttctgccaagaactcagggtggccctatgacttggaggagcaagatcagaccgctcaaaggtccccgtgttcactgttacccagaggctcttgttactacccacttcattccccaccgctgccagtgccactgccaaccctgttcacaggcgcttccagcccactccagccaggggagcagggaagaagaaggggctccctcctcttcacattccccccgaccccaaagccagagaaagccagatggcaccagctgctccggatgtgcctgcccacattgggggacagggccgggcctgggctcggttcccaggtttgagctctgcagcctctctcctggagtgagggggctgaagtcagaccaaaggaagaactcagaaatgtcttgtttatttgtgtttgtgaccaagcagcctctcccttcacccaggtttatggcctcgttttcacttgtatatttttcacactgtaaatttcttgtacaaacccaaagaaaaaattaaaaaaaatttttttgtttaaaaataa

SEQ ID NO: 148314 - DNA, 701 bp, Homo sapiens
  Payload ID: 9366
  Gene Symbol: LZTS2
  Gene Name: leucine zipper, putative tumor suppressor 2
  ENST ID: ENST00000429732
  CDS Start-End: 106-701
cagaggagggggctctgctggggagaggggctcagtctgttcttgtgaggctgagggtctggggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgc

SEQ ID NO: 148315 - DNA, 816 bp, Homo sapiens
  Payload ID: 9366
  Gene Symbol: LZTS2
  Gene Name: leucine zipper, putative tumor suppressor 2
  ENST ID: ENST00000426584
  CDS Start-End: 97-816
acctactctagggagggggctgtgctggttctgcctgggcagccccacgctgaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccacc

SEQ ID NO: 148316 - DNA, 804 bp, Homo sapiens
  Payload ID: 9366
  Gene Symbol: LZTS2
  Gene Name: leucine zipper, putative tumor suppressor 2
  ENST ID: ENST00000454422
  CDS Start-End: 143-804
cggggccggggccggggccggagccggagccggggccgggcggcgcgcctgtggagcgctgggggcggcctggggctgagcatggagcagcgcggcggaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctgg

SEQ ID NO: 148317 - DNA, 745 bp, Homo sapiens
  Payload ID: 9366
  Gene Symbol: LZTS2
  Gene Name: leucine zipper, putative tumor suppressor 2
  ENST ID: ENST00000481129
  CDS Start-End: 338-745
tatttgtgaagcacggcgtgtaagaagttgtctgtgtgagtgactgtgaatagaggctgtcaatgcgtgaaagatggttaggagactaagtgcacttgagactgtgactgggtgcgaaggactgcggattgttgtggaagcctgtgcccaacaggcctgtgacaccgtgtctgtgtgtgaggtggactggaagattatggaaagaaggaacgcggacccacgtgacggctgagactgcggctgcatgtgggaaaggtcttgtgggtgttagggagactgtattgtgtgcgagaaggtcgcctgcgaggccgctggccaggcctgagcctctgccaccatggccattgtgcagactctgccagtgccactggagcctgctcctgaagctgccactgccccacaagctccagtcatgggtagtgtgagcagccttatctcaggccggccctgtcccggggggccagctcctccccgccaccacggccctcctgggcccaccttcttccgccagcaggatggcctgctacggggtggctatgaggcacaggagccgctgtgcccagctgtgccccctaggaaggctgtccctgtcaccagcttcacctacatcaatgaggacttccggacagagtcaccccccagcccaagcagtgatgttgaggatgcccgagagcagcgggcacacaatgcccacctccgcggcccaccaccaaagctcatccctgtctctggaaagctggagaag

SEQ ID NO: 148318 - DNA, 5462 bp, Homo sapiens
  Payload ID: 9367
  Gene Symbol: LETM1
  Gene Name: leucine zipper-EF-hand containing transmembrane protein 1
  Uniprot ID: O95202
  ENST ID: ENST00000302787
  CDS Start-End: 298-2517
gaaccggtagtccgcggtggcgcggtccgcccctcacctggccagcggcgggcgctgaggggcccaatgggagccgcggcctggccgccccgccccgcgcctccggacgtctgtgccgggacaaggccgccgctggtgccgggtccttgaggagagcgcctcccgtccgaggccagccgcctctgtcagccgtccgcgcgggccgggtctgaagcgccgccgggacggcgaagagccgcggccgccgcggagaaggaggcagcgcaggaggccggagcggccgccgcgcccgagcacatggcgtccatcttactgaggagctgccgcggccgggcgcccgcccgcctcccgccgccgcctcggtacaccgtcccgcggggtagtccaggggatcctgctcatctcagctgtgccagcaccctggggttgaggaactgcctgaatgttccatttggctgctgcactcccatccaccctgtgtacacatcctccagaggcgatcacctcggctgttgggctctgaggcccgagtgccttcgcatagtgtcgagagcgccatggacctctacctctgtgggttttgtggctgtgggacctcagtgccttcctgtgcgtggctggcactcttcgcgccctgttcgcgatgactcggtagtagagaagtccctcaagtccttgaaggacaagaacaagaagctggaggaaggcggcccggtgtacagcccccccgcagaggtggtggtgaagaagtccctggggcagcgggtgctggacgagctgaagcactactaccatggcttccgcctgctatggatcgacaccaagatcgcggcacgcatgctctggcgcatcctcaacggccacagcctgacccgccgggagcgcaggcagtttctccggatctgcgctgacctcttccgcctggtgccgttccttgtgttcgtggtggtgccgttcatggagtttctgctgcctgttgctgtgaagctcttccccaacatgttgccatccacatttgagactcagtcactcaaggaggagaggctgaagaaggagcttcgggtcaagctggagctggccaagttcctccaggacaccatcgaggagatggccttgaagaacaaggcagccaagggcagcgccaccaaagacttctctgtgtttttccagaagatccgggaaacaggggagaggcccagcaatgaggaaatcatgcgtttttccaaattatttgaggatgagctgaccctggacaacctgacacggccgcagctggtggccctgtgcaagctgctggagctacagtccatcggcaccaacaacttcctgcgcttccagcttaccatgcggctgcgctccataaaggcagacgacaagctgattgctgaggaaggggtggacagcctgaatgtcaaggagctgcaggcagcgtgtcgggcacgaggcatgcgggccctgggcgtcacggaagaccgcctgaggggtcagctgaagcagtggctggacctgcacctgcatcaggagatccccacatcgctgctcatcctgtcccgggccatgtacctcccggacaccctctctccagccgaccagctcaagtccacactgcagaccctcccagagattgtggcaaaggaagcacaggtgaaagtggccgaggtggagggcgagcaggtggacaacaaggccaagctggaggccacgctgcaggaggaggcggccatccagcaggagcaccgtgagaaggagctgcagaagcgctcggaggtggcgaaggattttgagcccgaacgtgtggtagctgctccccaaaggccggggaccgagccacagccagaaatgcctgacacagtcctgcagtcagagaccttgaaggacactgccccggtgctggagggcttgaaggaggaagagatcacgaaggaggaaatcgacatcctcagcgatgcctgctctaagctgcaggagcagaagaagtcactcaccaaggagaaggaggagctggagctgctgaaggaggatgtgcaggactacagcgaggacttgcaggagatcaagaaggaactttcaaagactggtgaagaaaagtacgtggaagaatctaaagccagcaagagattgacaaaaagggtgcagcaaatgatcgggcagatcgatggcttgatctcgcagctggagatggaccagcaggctggcaagctggccccggccaacggcatgcccacgggggagaacgtcatcagtgtcgctgagctcatcaacgccatgaagcaagtcaagcacattcccgaaagcaagctcaccagcctggccgcagcactggatgaaaacaaggatggcaaggtcaacatcgacgacctcgtcaaggtgattgagctggtggacaaagaagatgttcacatctccaccagccaggtggctgagattgtagcaacactggaaaaagaggagaaggtggaggagaaggagaaggccaaagagaaggcagagaaggaggtcgcagaggtgaagagctagaaccactggcctgggcacctgtcctcctgctgtgccgtcaccctggcaagggccgtgagggcgattgctttgtggtgattctcagtggctcatctaatattttggctggaataaatcagagacttccataatcaagtaaattttaattttcatcattccacggagattcagtctgtctggaatcccggaacccctccacagaatcgtgtctggatccacactgtggtgtggctgccacggcctcctggctccagaggcagctgggctgggccaaggcaggaaggcgcccccatgtgtgtggcctcagtctcagcatctgactgtgctgccctgtccccagggaagagaatgaggaccacgtggactccgcccacacagagctggctgctgtgcccaccctcaggggcgtcaggagacacagcctggcctcctcagggctgaagatgcctccattcgcctgtggaccttgatttctagatttcagtgtcaatagacctgtcttcctgcacactttcagttggatgtgggtcattgtggagacagaggtgtctgccatctctgtggcctctggagagtgacgtctccctgctgggagtgctggttctcacgtgcggtttcccttgtgtatcggagctctttctcggctttctatttcccccagttctttaagcagtcaattggcacagagtttcccacgggggctgcagtggattcactgtgtcagggatgagcctggcttgggggttggtggggctctgaagcgcatttggggttctttgtagcttctaatgtgaggtttgagtccagtgcgcccacagcagcatgcccttctcaccccttgcagtgttgcaggctcaggcccctgggctccttcagcaagcaggctagtcaatgaggcatgaggatccggcacagggcatcccctggggcttcaagggcaatacccccgtgcttagggtttgccctgtgccctctgggtggggtggcctccccgcactcggcagcatggccaggctggccagggcgtgggcaggtggtgtcctgtggcacctccatcctcctgcccagccggctgtgtcacactcatctttttaaggtcaggttggttcctggcaaaaatgtacctccaggggcctccaagcataggatttggaagacaggaacggcacaggcgtccaggaaagcagctgcactcagacaatgccttctccattacttgaagcttctttctgttcagccattaaagaaacttgacaaaataggaacaggagatatttctcaattgtaaacctttgtgcagggacagttggcttccagaggctttcagctttcagttatttgagaagtttgttttagatccttaactaatatttatgaattctctcaccctgtgtaagtagcctggtgttcgtttgtccaagtgtacttacccttgagaacaagtcttgcagttgccaggtgtgtgcagacgcctctcctgtgagcggcatcgcgggcccagtcagctgccccggctctcatcctcgtcctcactgccttggctgagcactgttgacgtgaacagccactgcaacaggcagcccatcccactgtcccctctgccctggactccgcatggcctccaaaagccagcttgccctccgggtgctgcaggggctttgcaggtggggaaggctctggtgggtgcctttggtggcttccgtgacatcagccgtgctctgatgcaggcttgctccctcgtcattctccctcgtcattctccctcatcgttctgtgtgcatttttctctatgtcctgacctttcttcttgcacctaaaagtggtgtctgggtgcaaatgtaagcagtggtggatccagaaatatgagctttgtgtaataagcttcttaaaacagtcctttcttacacctgcccagggccagaccctcggtcttggcctttttcaggagctaggatatctgcgcctggtgaaaatgaaacgaattcctgatttaggaattcagtgtttcctcctcactccagctaagcactcacttttttttttttttttttttttttttgatacagagtctcgctctgtcacccaggctggagtgcagtggtgcgatctcggctcactgcaagctccacctcccgggttcaagcgattcttctgcctcagcctcctgagtaattgggattacaggcatgcgccaccatgcccagctaatttttttttttttttttgagacagagtcttgctctgtctcccaggctggagtgcaatggcgtgatctcggctcactgccagctccgcttcctgggttcacgccattctcctgcctcagcctcccgagtagccaggactacaagcacccgccaccacacctggctaatttttttgtatttttattagagacagtgttttaccgtgttagccaggatggtctcgatctcctgacttcgtgatctactcacctcggcctcccaaagtgctgggattacgggcaagtttttattagagatggggtttcatcatgttggtcaggctggtcttcaactcctgacctcaggtgatccacccgcctcagcctcccaaagtgctgggattacaggcatgagccaccgcgcccggcctgaactctcagttctaacgcagggattcaggaattgggctttcagactccttctgcagtgtcacagtccagactttttttaaatgaaggacaccccgcagtggctcacagtgggtcccagggctagcaggagcgtgctggggagccggctctgtctttgttcgcagtgggtcccggtgctggcaggagtgtgctggtgagccggctctgtctttgtaaatccttcaggggtcctacggctgactccaccggacagcccgtcctgggccgtgttaagcaccttttgtagaaatcgtatttttattaaaacatcaaatctgtgttcctgtaa

SEQ ID NO: 148319 - DNA, 1693 bp, Homo sapiens
  Payload ID: 9368
  Gene Symbol: LETM2
  Gene Name: leucine zipper-EF-hand containing transmembrane protein 2
  Uniprot ID: Q2VYF4
  ENST ID: ENST00000297720
  CDS Start-End: 233-1423
agagtgacgtcaggggcgaggaaagaggcggaaccgtagagacttggcttcgggcccttctagcttgggggtcccgggaaggagctgggaggacctaggcggccgttccgcggagcccggccgaggaggtccctatgttaactacttgagacaaaaataaatatggccttctacagttataattcagttctggctattgctcgaacaagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaagggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatca

SEQ ID NO: 148320 - DNA, 1873 bp, Homo sapiens
  Payload ID: 9368
  Gene Symbol: LETM2
  Gene Name: leucine zipper-EF-hand containing transmembrane protein 2
  Uniprot ID: Q2VYF4
  ENST ID: ENST00000379957
  CDS Start-End: 128-1603
gtagagacttggcttcgggcccttctagcttgggggtcccgggaaggagctgggaggacctaggcggccgttccgcggagcccggccgaggaggtccctatgttaactacttgagacaaaaataaatatggccttctacagttataattcagttctggctattgctcgaacaagattccctagccattttgtccatcctacctgctcttcttattccccatcatgtgcatttcttcacttgccagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaaggctgttgagaacttgtgttgatttcttccgcctggttccatttatggtgttcttaattgtacccttcatggaattcttattaccagtgtttctgaaactcttcccagagatgttgccatcaacttttgaaagtgaatccaaaaaggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatca

SEQ ID NO: 148321 - DNA, 1776 bp, Homo sapiens
  Payload ID: 9368
  Gene Symbol: LETM2
  Gene Name: leucine zipper-EF-hand containing transmembrane protein 2
  Uniprot ID: Q2VYF4
  ENST ID: ENST00000523983
  CDS Start-End: 173-1507
tagcttgggggtcccgggaaggagctgggaggacctaggcggccgttccgcggagcccggccgaggaggtccctatgttaactacttgagacaaaaataaatatggccttctacagttataattcagttctggctattgctcgaacaagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaaggctgttgagaacttgtgttgatttcttccgcctggttccatttatggtgttcttaattgtacccttcatggaattcttattaccagtgtttctgaaactcttcccagagatgttgccatcaacttttgaaagtgaatccaaaaaggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatc

SEQ ID NO: 148322 - DNA, 2745 bp, Homo sapiens
  Payload ID: 9368
  Gene Symbol: LETM2
  Gene Name: leucine zipper-EF-hand containing transmembrane protein 2
  ENST ID: ENST00000523268
  CDS Start-End: 102-611
agcttgggggtcccgggaaggagctgggaggacctaggcggccgttccgcggagcccggccgaggaggtccctatgttaactacttgagacaaaaataaatatggccttctacagttataattcagttctggctattgctcgaacaagattccctagccattttgtccatcctacctgctcttcttattccccatcatgtgcatttcttcacttgccagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaaggtgtttctgaaactcttcccagagatgttgccatcaacttttgaaagtgaatccaaaaaggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatcatgttgtttttttagtttcatgtgtacgtcccttcagagaggaaattttttgcacaatggaatcagcttggcaccttagatacctgtctcctatggcttggaattctgagtaagaacttggaagttccaaaaaccattttaggagcacctgattaactttctgaatgatccaccagtaggatcagcaccctggaaacaaagtaccttatgagatgggatggatatactccccagtaagatctttctggatataatgaagcttcctggagaaacagactggcaatcagaaagatttggctgcttccgacacctccatcttgggcctgcagaggctgcagcaatctgtgaggcagccgcaatctgcgaggcagccactcttctagcacatatggctttcattagccaccattttgctaggaagcataattaagggtttaagccttaaccatgtttgtgttgggtgtgtgtgtttctggccagtttgtctttcacaaataagactattagtcatagggattgtgaaagtctgatataatccctgtgctacccagcaacaagtattacattaggatatttatgcttggtgttttcagtattaataatatgaaataatagatagactgccatgcagctgaccaagggctttcttcccctggggagtggttagaaggccaaaggtatttcagcctgtaggtgataaaattagatttctttacttgctgtggttagacagcagtcagttaaaacaagtaaaactccactgtcctgtctgggatcacctaaatgaggaatgtcaccagcacttcacagcaagaatatgcattctacaatgctttctaaatttgtgctccatcagagaagccccaccatgtcccactaatgaagcccagttctttgggaatgatgaatccctactgtgcacatacagcaatcatggatcctgcctatcgaggtgattcacaatacactttcccatttcaaaaa

SEQ ID NO: 148323 - DNA, 2250 bp, Homo sapiens
  Payload ID: 9368
  Gene Symbol: LETM2
  Gene Name: leucine zipper-EF-hand containing transmembrane protein 2
  ENST ID: ENST00000518883
  CDS Start-End: 787-1155
tagcttgggggtcccgggaaggagctgggaggacctaggcggccgttccgcggagcccggccgaggaggtaggggtgggcaggcccagccctcaggccgcgacctggtgggccgcgctgcctttttttcctccggatcccgctcggtccgcatcctgctcctctcatcagagcatgatccaggcttctgacagcttccagttcccaccgcgctctcctccacccacgacctcatccccgccagttccccagcacagcgcgaactctgaagctcggcctctcctcccccttccccgcacagcgcgctccgtccttttttccgtcccaggccctgcttctttctcctcggcttcatttccaacaaccccgatcatccacgagggtcgtcgttcccgtgcctgtcccacctccgcaccagaaaaccaaagcatatcccccagaccccgccgcatgcaggccgcgcacacatcaggcgcgccgaagccgccgggcgaggaagccgagggcgcgttttgctcccgtgtggtgatgggcaaagccgagggagcccgggagcagcgggcgtggggcggcgccaatgcgagtgcgagtggtgtccgccgcccgggagcgcccgggcccgagcggattaaccgccgcctcaggtgtcgtctcctgcccgcgaaacaccacccaccgttagtgtccctatgttaactacttgagacaaaaataaatatggccttctacagttataattcagttctggctattgctcgaacaagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaaggtgtttctgaaactcttcccagagatgttgccatcaacttttgaaagtgaatccaaaaaggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtccca

SEQ ID NO: 148324 - DNA, 2240 bp, Homo sapiens
  Payload ID: 9368
  Gene Symbol: LETM2
  Gene Name: leucine zipper-EF-hand containing transmembrane protein 2
  ENST ID: ENST00000519476
  CDS Start-End: 301-822
acgcgccttaaaccaagccccacaaagaagtcacttcggcgatgtaaacgcgactttgcggcttcctgggctgctaaggtgaaggacgcccgccctccccagaacttgagagcttattggttggcgatgtcgtcactcagagtgacgtcaggggcgaggaaagaggcggaaccgtagagacttggcttcgggcccttctagcttgggggtcccgggaaggagctgggaggacctaggcggccgttccgcggagcccggccgaggaggtccctatgttaactacttgagacaaaaataaatatggccttctacagttataattcagttctggctattgctcgaacaagattccctagccattttgtccatcctacctgctcttcttattccccatcatgtgcatttcttcacttgccagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaagggtaggcaagaatcatatttgagaaagaaaatgtgaaattaaaatgaactatttgggaactcaactatttaaattcaacgtaaacttcatcttaaaaatcccagagtaggaataataactgctggtgagaaccagtttcttgtctgcaaccgacttactgtacaactttagtcagtattctgaaatttgttatatattttcctgtataacggtttttaaaaaaaacttttattttaggttcaggggtacatgtgcatgtttgtagaatagttataattgtgttttttaatctttccaagaagttgaggggcttcatgtttcaactgttgttaatatattaagcatatgcatttttaaaacccaattttggctgggcacgatggcttatgcctgtaatcccagcactttgggaggctgaggcgggcggatcacttgaggtcaggagttcaagaccagactggccagcacgatgaaacccttgtctactaaaaaaaatacaaaaattagccgggcatggtggcacgtgcctgtagtcccagctacccaggaggctgaggcaggagaatggcttgaacttgggaggcggaggttgcagcgagccgagatcgtgccactgcactccagcctggagtgagatgccatctcaaaaaaacaaacaaacaaaaaaacaattttaagtaatacaatgctattaaagtatggaccctctaacatagatgaagtctaggagatgccaataatatttttattgtcatagatttccttcaagatagcccctaaaagttacttcagagctatggtaaacaggaaaaccctgcctcttcattttataaacagctgcagaaaacctgtcttgggtttttaacactttaagaaccaagctgagcatggcacatatgcctgtaatcccagctccttgggaggctgaggtggaaggattgcgtgagcccaggagtttgaggccagactgggcaacatagtgagacactatctcttgaaagaaagaaaatgaaacaagacagggtttttttggttttgtttttcatttttgtttttggcatgccctaaaataatgaatattgcatatgcatttaattctatagctgttgagaacttgtgttgatttcttccgcctggttccatttatggtgttcttaattgtacccttcatggaattcttattaccagtgtttctgaaactcttcccagagatgttgccatcaacttttgaaagtgaatccaaaaaggtatgattttttaactttaataaaatttaataaaccttattagaggagtttttaggtttacagaaaacttgggcagaaagtactacttctccccacccaaccccatcccaatttctcctgtaattaatatcttgcattagtgtgctatatttgtaatgattaaaaaaaccaatattgacatgttattattaaa

SEQ ID NO: 148325 - DNA, 1459 bp, Homo sapiens
  Payload ID: 9368
  Gene Symbol: LETM2
  Gene Name: leucine zipper-EF-hand containing transmembrane protein 2
  ENST ID: ENST00000524874
  CDS Start-End: 128-1459
gtagagacttggcttcgggcccttctagcttgggggtcccgggaaggagctgggaggacctaggcggccgttccgcggagcccggccgaggaggtccctatgttaactacttgagacaaaaataaatatggccttctacagttataattcagttctggctattgctcgaacaagattccctagccattttgtccatcctacctgctcttcttattccccatcatgtgcatttcttcacttgccagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattgacgccaaagttgctgccagaatggtttggaggctgttgcatggacaggtcctgaccagacgagagagacgaagggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataa

SEQ ID NO: 148326 - DNA, 557 bp, Homo sapiens
  Payload ID: 9368
  Gene Symbol: LETM2
  Gene Name: leucine zipper-EF-hand containing transmembrane protein 2
  ENST ID: ENST00000527334
  CDS Start-End: 209-557
aatccagtcttcaatcacgggtttcctcgggcgttagccactgcctgcggagtgtggactggcagaaaaacgtcaccttcgggccccccagcaccaacgcgccttaaaccaagccccacaaagaagtcacttcggcgatgtaaacgcgactttgcggcttcctgggctgctaaggtccctatgttaactacttgagacaaaaataaatatggccttctacagttataattcagttctggctattgctcgaacaagattccctagccattttgtccatcctacctgctcttcttattccccatcatgtgcatttcttcacttgccagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaag

SEQ ID NO: 148327 - DNA, 529 bp, Homo sapiens
  Payload ID: 9368
  Gene Symbol: LETM2
  Gene Name: leucine zipper-EF-hand containing transmembrane protein 2
  ENST ID: ENST00000527175
  CDS Start-End: 1-259
ggagaacgtccctccttcccttttgctcctgtcccgcaccttctacctgatagatgtgaagcccaagccgattgagataccactcagtggggaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatca

SEQ ID NO: 148328 - DNA, 554 bp, Homo sapiens
  Payload ID: 9368
  Gene Symbol: LETM2
  Gene Name: leucine zipper-EF-hand containing transmembrane protein 2
  ENST ID: ENST00000526356
  CDS Start-End: 128-554
aggtgtcgtctcctgcccgcgaaacaccacccaccgttagtgtgggtccacaggtttcgagcccctgttgaaaatgtcagctctgtggctaaggtccctatgttaactacttgagacaaaaataaatatggccttctacagttataattcagttctggctattgctcgaacaagattccctagccattttgtccatcctacctgctcttcttattccccatcatgtgcatttcttcacttgccagattcccatttaaataagacatgtatgaagaactatgagagcaagaagtactcggatcctagtcagccaggcaatacagtacttcacccaggaactagactaatacaaaagctacacacatccacttgctggctgcaagaagttcctggcaaacctcagctggagcaagccacaaaacatccacaggtgacaagccctcaggccacaaaagaaactggcatggagattaaagaaggcaaacaatcttatagacaaaaaatcatggatgaactaaaatattattacaatggattctacttactttggattg

SEQ ID NO: 148329 - DNA, 1261 bp, Homo sapiens
  Payload ID: 9368
  Gene Symbol: LETM2
  Gene Name: leucine zipper-EF-hand containing transmembrane protein 2
  Uniprot ID: Q2VYF4
  ENST ID: ENST00000527710
  CDS Start-End: 158-991
agtaggtatgatttagtcagcccaacagacagttcagcagcccctgagaagagggagccttcactgagtgtggcagtcactgtgccggtgagaaaacagaggcagctccttccttctccccgttctgtgccactctactagacagcgttgacagcatatggaagaaaaacagaaaaagaaaatggctgtaaagttggaactagcaaaatttcttcaagaaaccatgacagaaatggcaaggaggaacagagccaagatgggcgatgcctctacacagctctcatcctacgtgaagcaggtccagacaggccacaagcccagcacaaaggagatagttcgcttctccaaactatttgaggaccagctggccctggaacacttagatcgccctcagctggttgccctttgcaaactgctggaattgcagacatttggaaccaacaacctgctccgctttcagctcctgatgaaactgaagtctataaaagcagatgatgaaataattgccaaggaaggggtgacagcattgagtgtatcagaactacaggctgcctgtagggcccgagggatgagatcactgggtctcacggaggaacaactgcgacaacagctcacggagtggcaggacctccacctgaaggagaacgtccctccttcccttttgctcctgtcccgcaccttctacctgatagatgtgaagcccaagccgattgagataccactcagtggggaggctccaaagactgatattcttgtggaattacctactttcactgaatctaaagagaacatggtggatcttgcacctcaactgaagggaactaaggatgaagactttatacagccgccaccagttacatcatcacccataacaccatcaacacctatttcattacctaaaggacccatcacttcttctgaagaacctacactccaggccaaatcacaaatgacggcccagaacagcaaggctagttcaaaaggagcataaaggactacttgaggatggagctcactctcttcagcttccggccctcaacagtggcatctgtaaaggacctcccagataagactgtctggcttcagagagcggatcagctgtttagcccgtggggcagtcctttgaggcctggtaaccattccaggtgatgtgggtagtgagaccaagttcagaccacttagaaaaatataattgcaaagtcccatttcctctgtaccattgtcaccccactcaactttgtataaagcccaccccccatca

SEQ ID NO: 148330 - DNA, 2572 bp, Homo sapiens
  Payload ID: 9369
  Gene Symbol: LEKR1
  Gene Name: leucine, glutamate and lysine rich 1
  ENST ID: ENST00000356539
  CDS Start-End: 115-2193
agccgactggcggcgcggtcgcccgggagaccgggaaagccgtttcacacccgtcctagtcgaagtcgagatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtgtagatcgtgaaaagagacttcaagaaaagctgcattctcttagccaagaacttgaacagtacaaaattgacaacaaatccaaaacagaaagaatttacgatgtaggcatgcagttaaaaagtcaacaaaatgaatttcagaaagtaaagaaacaactgagtcatttgcaagatgagctaaaaattaaatatagacaatcatacatcttcagtcaaagattgtcagagtacaaatatttctggaataagactctttcattacttacttttactaaaagggaactaaccagtattaaaaatgaagtatatgataattaccaaaactggacttcattgaaaggagcagtttttctacaaattaaatctataagtgaaacagccttgacagaaatagacatactgaataaaagtttgacagtatcccagagaaataaagtatgccttgaaaaggaaatgaaaaatctgaaattgttgtcagatgcagccatattgagatctcagcagattcggacatctagacaacaggaagtaaacttgcaaaccagatgctatgatttgcaaaaagaagtactagatttacaatgtctagtagaggcacttggattaaaacttcagaaggcggtgacagagatggacaactataaagaaatgcttatgaataaatctaatgaagctgatgactgtcaaagagaacttaaaaaactgaagtttgaatccattatttctgagtcacagcatactatgctgcttaaggaaaaagaagactctttaatgacttgtcaacagatatataaagcattacaggaagagctgactgtgaaagaaaagcaagaagaagacataaagagaagaattaaccttgcagaaaatgaactggagataaccaaaactcttctgaatcagacaagggaagaggttttaacactgaaaaatgaaagggaattgatgctgatttcacatcagaaaagcatcgagcagctgcaagaaacccttagacagaagctgctgagtgatgataactggaaggagaagattgaagcagaacttgccaaggaaagggcccaacacttggttgaatttgaagagcaagctcttctctttaaggaagaaacaaaattgcaacttgatattgaaaaagaaaaacaccaagatgtaatccaaaagtataagaaagaacaagaggaactacaaatgaagatatctgacttaatcacaggcgctacaagagatctaaggcaggaagtgaccactcttaaagaaaaacttcacaaatcccatattcggtacactgaagaatctaattcaaaggaaaaagaaattgaaaatcttaaaaatttggttgcagaatttgaatctcgcttgaagaaggaaattgacagtaatgattcagtttcagaaaacttgaggaaggaaatggaacagaagtcggatgaactgaaaagagtaatgctggctcaaacacaactgatagagcaatttaaccagtcccaggaagagaatacttttcttcaggagacagtgcgtagagaatgtgaagaacgctttgaactgacagaggctttgagtcaagccagagaacagctcctggagctcagtaagcttcgtggaagtttaccattctcaccgtgttccctcagcaagggcagcctaacctcccctgctgcagcagtcagtaatcatggagagagaagccttgcaagactgaactctgaaaaaggaatccaaattcccaacctgcgcggggtgtcaaaacccaccactttcccaacctcagataagccgaagagggttagatcaggcgtgcccattctcccccagccacatcctcccaggggtggagcatcttcagcaaatgagactagacagagactggctgccattcttaggagaaggcggagtcagcaatgatccaaaatgaggagcaggaagctccctacagcgtgcacgctctttcagagagtgccaggaattcactgtaactgagaatgacaatgataaaattattttcacagatcaggaaggcatacctatagatgtatttaacaaaagactgtaaaaagctggaaaattgtgaagccttatttttcaagagggttttgatagagtaacagatcattaagttgttggtattccagaggtccgatttctatgtttatgttggaatgtgctctatgaatatagccttttagagatcacaggtaaaatttttcacccataacatcttttcaatttcttgcgccactacaagcagatatatttccacaaaaaaatagattgtttgagattt

SEQ ID NO: 148331 - DNA, 2881 bp, Homo sapiens
  Payload ID: 9369
  Gene Symbol: LEKR1
  Gene Name: leucine, glutamate and lysine rich 1
  Uniprot ID: Q6ZMV7
  ENST ID: ENST00000470811
  CDS Start-End: 1336-2502
agccgactggcggcgcggtcgcccgggagaccgggaaagccgtttcacacccgtcctagtcgaagtcgagatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtgtagatcgtgaaaagagacttcaagaaaagctgcattctcttagccaagaacttgaacagtacaaaattgacaacaaatccaaaacagaaagaatttacgatgtaggcatgcagttaaaaagtcaacaaaatgaatttcagaaagtaaagaaacaactgagtcatttgcaagatgagctaaaaattaaatatagacaatcatacatcttcagtcaaagattgtcagagtacaaatatttctggaataagactctttcattacttacttttactaaaagggaactaaccagtattaaaaatgaagtatatgataattaccaaaactggacttcattgaaaggagcagtttttctacaaattaaatctataagtgaaacagccttgacagaaatagacatactgaataaaagtttgacagtatcccagagaaataaagtatgccttgaaaaggaaatgaaaaatctgaaattgttgtcagatgcagccatattgagatctcagcagattcggacatctagacaacaggaagtaaacttgcaaaccagatgctatgatttgcaaaaagaagtactagatttacaatgtctagtagaggcacttggattaaaacttcagaaggcggtgacagagatggacaactataaagaaatgcttatgtaagatggagaatattaaacaacttataacagtgctctgtagatgtgttacaaaatggcaagaattaggaagaaatgacaagaattataaagaccctgcctgggcaacacggagaaactttgtctccacaaaaaaatacaaaaattatccatgcgtgttggcacactcctgtagtcccagctactcgggaggctgaactgggaagatcacctaagcctagaaagttgaagctacagtgaaccatgatcatgccactacactccagcctgggcgacagagtgagaccctgtctcaaaatgaataaataagaataaatctaatgaagctgatgactgtcaaagagaacttaaaaaactgaagtttgaatccattatttctgagtcacagcatactatgctgcttaaggaaaaagaagactctttaatgacttgtcaacagatatataaagcattacaggaagagctgactgtgaaagaaaagcaagaagaagacataaagagaagaattaaccttgcagaaaatgaactggagataaccaaaactcttctgaatcagacaagggaagaggttttaacactgaaaaatgaaagggaattgatgctgatttcacatcagaaaagcatcgagcagctgcaagaaacccttagacagaagctgctgagtgatgataactggaaggagaagattgaagcagaacttgccaaggaaagggcccaacacttggttgaatttgaagagcaagctcttctctttaaggaagaaacaaaattgcaacttgatattgaaaaagaaaaacaccaagatgtaatccaaaagtataagaaagaacaagaggaactacaaatgaagatatctgacttaatcacaggcgctacaagagatctaaggcaggaagtgaccactcttaaagaaaaacttcacaaatcccatattcggtacactgaagaatctaattcaaaggaaaaagaaattgaaaatcttaaaaatttggttgcagaatttgaatctcgcttgaagaaggaaattgacagtaatgattcagtttcagaaaacttgaggaaggaaatggaacagaagtcggatgaactgaaaagagtaatgctggctcaaacacaactgatagagcaatttaaccagtcccaggaagagaatacttttcttcaggagacagtgcgtagagaatgtgaagaacgctttgaactgacagaggctttgagtcaagccagagaacagctcctggagctcagtaagcttcgtggaagtttaccattctcaccgtgttccctcagcaagggcagcctaacctcccctgctgcagcagtcagtaatcatggagagagaagccttgcaagactgaactctgaaaaaggaatccaaattcccaacctgcgcggggtgtcaaaacccaccactttcccaacctcagataagccgaagagggttagatcaggcgtgcccattctcccccagccacatcctcccaggggtggagcatcttcagcaaatgagactagacagagactggctgccattcttaggagaaggcggagtcagcaatgatccaaaatgaggagcaggaagctccctacagcgtgcacgctctttcagagagtgccaggaattcactgtaactgagaatgacaatgataaaattattttcacagatcaggaaggcatacctatagatgtatttaacaaaagactgtaaaaagctggaaaattgtgaagccttatttttcaagagggttttgatagagtaacagatcattaagttgttggtattccagaggtccgatttctatgtttatgttggaatgtgctctatgaatatagccttttagagatcacaggtaaaatttttcacccataacatcttttcaatttcttgcgccactacaagcagatatatttccacaaaaaaatagattgtttgagattt

SEQ ID NO: 148332 - DNA, 546 bp, Homo sapiens
  Payload ID: 9369
  Gene Symbol: LEKR1
  Gene Name: leucine, glutamate and lysine rich 1
  ENST ID: ENST00000483177
  CDS Start-End: 111-482
gactggcggcgcggtcgcccgggagaccgggaaagccgtttcacacccgtcctagtcgaagtcgagatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtgtagatcgtgaaaagagacttcaagaaaagctgcattctcttagccaagaacttgaacagtacaaaattgacaacaaatccaaaacagaaagcaaaatatacttcagactcatgcttagactggaagtagaacattgccagctgaaagaacgaatgccagatctacaacattctgtcactgagccatacataggtctgtgatttgttttccttagcttttcttaataactttgtttttgcaaaataaatatttttttgaaatgaa

SEQ ID NO: 148333 - DNA, 621 bp, Homo sapiens
  Payload ID: 9369
  Gene Symbol: LEKR1
  Gene Name: leucine, glutamate and lysine rich 1
  ENST ID: ENST00000477399
  CDS Start-End: 108-506
tggcggcgcggtcgcccgggagaccgggaaagccgtttcacacccgtcctagtcgaagtcgagatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtgtagatcgtgaaaagagacttcaagaaaagctgcattctcttagccaagaacttgaacagtacaaaattgacaacaaatccaaaacagaaagaatttacgatgtaggcatgcagttaaaaagtcaacaaaatgaatttcagaaagtaaagaaacaactgagtcatttgcaagatgagctaaaaattaaatatagacaatcatacatcttcagattgtgcttttgctgatgtctgtaagaactctgtctaagccggtcagaaggattttctcctgtattttcttctaagtgttttatagttttagctcttctttagatctatgatctatttcagctaacttctg

SEQ ID NO: 148334 - DNA, 616 bp, Homo sapiens
  Payload ID: 9369
  Gene Symbol: LEKR1
  Gene Name: leucine, glutamate and lysine rich 1
  ENST ID: ENST00000498839
  CDS Start-End: 122-454
gacgtccagccgactggcggcgcggtcgcccgggagaccgggaaagccgtttcacacccgtcctagtcgaagtcgagatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtgtagatcgtgaaaagagacttcaagaaaagctgcattctcttagccaagaacttgaacagtacaaaattgacaacaaatccaaaacagaaaggttgagtatgtttttcttttctatcatttatttagttgaaagacagctacaggaaataaatacactttgaatgtttttctaaaatttctctacatcaggtatagtttatactttaatgcatttgtttcttaattatattaataattactaaatataattattatagtttgctttcttttgaggcatatatttactatctgaaaaattagaaaccaattaatttagtaaccac

SEQ ID NO: 148335 - DNA, 1940 bp, Homo sapiens
  Payload ID: 9369
  Gene Symbol: LEKR1
  Gene Name: leucine, glutamate and lysine rich 1
  ENST ID: ENST00000491763
  CDS Start-End: 796-1194
gtcctagtcgaagtcgaggtgagggacgatggctttcctcagcctgggatgacccggtcctccaaatgcagttccggagtggaggcgtgctcgcacccggggagagagccagaaagctgagccgcggcgccccagcgagagcacgaggccccgggtctggactccgccaccacgctcctctgcggccccttcctggtgtctgccagcccgcggggcccaggcgcggtccgccttcctcccagccccggggaacgcgcggctctgcttcctcacccccgcaccctcctcctcctcctcttccggccactgcaggtccagggggaacggggttagaaagggacagatttgaaagccattccagcagttttgtctggccttgcggttggtttctgtgtggaagagcctgccgcttcaggaaagtcttaggatgtgaactcccgccttcacctgcccctgacctgctcgttgtgggtgattcacgccatgggaatggttctttacgtaagggcttgaaagctgaacgtgagttaatggcctgacgtgacactagtgtgagaaacggaattggaaacgaacaaggacgtgtctgcattttaaaaaatgtcttttcggtgatcttgttagagaggaggttcacaaacacccacgtagctgcagccacttatcactgcacctcttgccaaagtgcggtccacatacgtgcaatgagaaaggattaaagggacttgtttgataacacacgcaaaactatatttcctttggcttcaaagctctctcaccatattttgggaagttatggatcatcacattcccatgcatgcgttgcctgaagaaatccaaaagatgttgcctgaagaaaaagtttgtaagtactgtggagtcagctatctaattcttcatgaatttaaggctatggaagaaaaagtgaaagcaatggaaaaagagatgaaattttatcaaggaagtgtagatcgtgaaaagagacttcaagaaaagctgcattctcttagccaagaacttgaacagtacaaaattgacaacaaatccaaaacagaaagaatttacgatgtaggcatgcagttaaaaagtcaacaaaatgaatttcagaaagtaaagaaacaactgagtcatttgcaagatgagctaaaaattaaatatagacaatcatacatcttcagattgtgcttttgctgatgtctgtaagaactctgtctaagccggtcagaaggattttctcctgtattttcttctaagtgttttatagttttagctcttctttagatctatgatctatttcagctaacttctgtgtatgatatgaggtaagaatctaaattcatcctgtttcacgtggatattcaattgttccagtgctgtttgttagaggccaatttttccttattgaattgcctcagcatctttgcctaaaataaattcaccataaatgtaaaggattatttttggattttctattctattccattaatctatatgtcttatgtcagtgccacactctcttaagtactacagtttttaataaattttaaaatcaagaaatataattactctaacttccttcttcgttttcaaaattgtttttgctattctgcgccctccataatgaattttaggatcagcttgtgaatttctgcaaagtaacctgctgggattttgataggtatagtattgaatctatagatcaatttggggagaatttctaccttaaaatttttgtatctttcaattcatgaatgtggtatgtttttccatggagatctttagccctctcaaaaatgttttgttttcttgaacttcttttattacaatttatttctaagtgttttattctttttatgttgttatgaattgggactgttaattttatcttggggattggtcattgttaatatacagaaataaaattgatttttgtatatgta

SEQ ID NO: 148336 - DNA, 3036 bp, Homo sapiens
  Payload ID: 9370
  Gene Symbol: LRG1
  Gene Name: leucine-rich alpha-2-glycoprotein 1
  Uniprot ID: P02750
  ENST ID: ENST00000306390
  CDS Start-End: 462-1505
caatatcaacataccatgaaatcaagacgagtttttttgttcttttcagtgagcttctgggttgctcaagtttatggtaaatccctcctcttgctcagagagctgtccctgtctccaggaatagtgccttgcaaaccttgacccttgaactccgggttgggggaagtgaggatgcaactagagagactcttggatgccccccaaaaatcaggaagcaaggaaagaaaaacctgtgttctagaagcagggtcaaaaaggggttgaacaggaaacaatttccaggaagcaattttgtaatcctgacccctccccttcccctgcctggcttaggctcagcccctatcaggaactggacgggggtggggacttccccagggttggttcccctgcccccagtccaggcaggtataaggccacctccgcaggccaggacaacccagaagcaaaagagcagagctaccatgtcctcttggagcagacagcgaccaaaaagcccagggggcattcaaccccatgtttctagaactctgttcctgctgctgctgttggcagcctcagcctggggggtcaccctgagccccaaagactgccaggtgttccgctcagaccatggcagctccatctcctgtcaaccacctgccgaaatccccggctacctgccagccgacaccgtgcacctggccgtggaattcttcaacctgacccacctgccagccaacctcctccagggcgcctctaagctccaagaattgcacctctccagcaatgggctggaaagcctctcgcccgaattcctgcggccagtgccgcagctgagggtgctggatctaacccgaaacgccctgaccgggctgcccccgggcctcttccaggcctcagccaccctggacaccctggtattgaaagaaaaccagctggaggtcctggaggtctcgtggctacacggcctgaaagctctggggcatctggacctgtctgggaaccgcctccggaaactgccccccgggctgctggccaacttcaccctcctgcgcacccttgaccttggggagaaccagttggagaccttgccacctgacctcctgaggggtccgctgcaattagaacggctacatctagaaggcaacaaattgcaagtactgggaaaagatctcctcttgccgcagccggacctgcgctacctcttcctgaacggcaacaagctggccagggtggcagccggtgccttccagggcctgcggcagctggacatgctggacctctccaataactcactggccagcgtgcccgaggggctctgggcatccctagggcagccaaactgggacatgcgggatggcttcgacatctccggcaacccctggatctgtgaccagaacctgagcgacctctatcgttggcttcaggcccaaaaagacaagatgttttcccagaatgacacgcgctgtgctgggcctgaagccgtgaagggccagacgctcctggcagtggccaagtcccagtgagaccaggggcttgggttgagggtggggggtctggtagaacactgcaacccgcttaacaaataatcctgcctttggccgggtgcgggggctcacgcctgtaatcccagcactttgggaggcccaggtgggcggatcacgaggtcaggagatcgagaccatcttggctaacatggtgaaaccctgtctctactaaaaatataaaaaattagccaggcgtggtggtgggcacctgtagtcccagcaactcgggaggctgaggcaggagaatggcgtgaacttgggaggcggagcttgcggtgagccaagatcgtgccactgcactctagcctgggcgacagagcaagactgtctcaaaaaaattaaaattaaaattaaaaacaaataatcctgccttttacaggtgaaactcggggctgtccatagcggctgggaccccgtttcatccatccatgcttcctagaacacacgatgggctttccttacccatgcccaaggtgtgccctccgtctggaatgccgttccctgtttcccagatctcttgaactctgggttctcccagccccttgtccttccttccagctgagccctggccacactggggctgcctttctctgactctgtcttccccaagtcagggggctctctgagtgcagggtctgatgctgagtcccacttagcttggggtcagaaccaaggggtttaataaataacccttgaaaactggatcggatgaattggctttcattgtgttcctagcatcttctcaaatcaacttcccaggactccagggtgaaggaggaaaagaggcatggcccaggccctggggtgtgggatatggtctccctaggggatgacagttgggatcaatggcctgtgacttctcctctcccttcccccatcctgggacctaactggaaataaaaccttgactgttgcccgggtgtcattttaccagtggatttctgccagggcttgtgtcctaggagaaggtttaagttaaaccagattgcccaggtctccaaacgatttgtcatgctgacctgagatcatcgaagggggcacctgcccccgggcaaggttgcaggggcaggatggggctgaagggatgagcagggtcccgggcccacctgctgatacagcattggccatgtgggggctgcaatcggatttggaagaccctggggcttgggggcatgtccagttttcccagctccctaaaaaatgaccatgcagcctggcgccgtggctcatgcctgtaatccaaacactttgggaggctgaggcaggcagatcaccggaggtcaggagttcgagaccagactggccaacatggcaaaaccctgtctctactaaaaatacaaaaattagccaggcacagtggcacgtgcctgtaataccagctacttgggagggtcaggcaggagaatcacttgaacctgggaggcggaggttgcagtgagccaagatcacgccactgcactccaggctgggcgacagagtgaaactgtgtctcaaaaataaaaataaaaat

SEQ ID NO: 148337 - DNA, 6335 bp, Homo sapiens
  Payload ID: 9371
  Gene Symbol: LRPPRC
  Gene Name: leucine-rich pentatricopeptide repeat containing
  Uniprot ID: P42704
  ENST ID: ENST00000260665
  CDS Start-End: 59-4243
acatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattcacttattagtctgctgtttctctgaaaaattttagagctaggtatagtgaccgtgaactttctaacgcataatattctgtgatacagccattccgtacatgtgtgaagtcctgcataactttcgaactttgttaaatgttggcactaggagtcatcagatctaggcttcatcattttccagtgagaagcagagacccaaagggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattgaatctcatgcctgttaatatctacactgtaagtagtgacttcaaaaaaattctaagataggtagtcaggagagtttgccattataaaaggtgtcttaataatatggaatattgacctaactggagatgaggtaattaattaccgaaatgttgaaaatgttttgagaactctccccattttggggtattccttgttcatttgaatttggtgactccctactgttccagtttcagtgccaacttgggtcacactgttcacatcaggggagaccttgccttggggacgtaggcgggcctcttgcaacttgtgctgttgaccttctgtcttgtggaactctctctcctgcatctgctacctgcccgcagatggtgtgagggagggttgatggcgggaagccaggaagtagatgtcatcatggtattggccaggcttttacttcaactctttttgtggcgttagatttaaggaagcagggggcatggccaacgttgagtcttggcccagtggacatagtgcggctttcccttgagcactgcccagatgcaggacctgcacatgttacaggtttgccaaaagcatctttttttttttttttttttttgagatagtcttgctctgttgcttaagccagagtgcagtggcgcaatctcagctcactgcaacctccgcctcctgggttcaagtgattcttgtgcctcagcctcccacgtagctgagattacaggcttgcaccaccatgttcagctaatttttgtatggtaaagacggagtttcaccatgttggccaggttggtctcgaactcctggccccaagtgatcctccccctgcgctcgcttcagcctcccaaagtgctgggattacaggtgtgagccaccacgcctggccaagagcctcactcctgtctttagtgattgcactgaagcaggcctcatttttttgcagtcatgctaaccacaagttagtcaacattcactaattgacattcattagaataggtctccaaggtgaggcataacgttggggtgtaatctggatttcgcagtcatctttttggggaaactgaaagtaccatctcatttgcatgaagtgactccacactggccctgtatatggactctggtaaaatgtgagtgtggtacagaggaaataggtaagacccccttatctagccctctcggcagcagcgggggggtgttacaaaggactagctgttcaaatatcttttgtattgtattg

SEQ ID NO: 148338 - DNA, 1848 bp, Homo sapiens
  Payload ID: 9371
  Gene Symbol: LRPPRC
  Gene Name: leucine-rich pentatricopeptide repeat containing
  ENST ID: ENST00000409946
  CDS Start-End: 32-1627
gcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcattttattttccaatctgacaagaagaaaacagagaagcattagcagaggaatctgggctcacgaggtggatccatgagagctgccttttccttttatcatatcatccattccacttcgttgtcaacctcttgatttttcaggcttgtttgttgctaaggaaactagatgctttttgtcagcagccttcatagctgagatgtttctggtcatctttttaatgaataaaaacttgacaata

SEQ ID NO: 148339 - DNA, 1610 bp, Homo sapiens
  Payload ID: 9371
  Gene Symbol: LRPPRC
  Gene Name: leucine-rich pentatricopeptide repeat containing
  ENST ID: ENST00000409659
  CDS Start-End: 43-1557
cttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggtgagtacaagtgtggttttaatttaataattgaagaggatatctttcctccttaatgtttagtgttgacacacaaaaaa

SEQ ID NO: 148340 - DNA, 1209 bp, Homo sapiens
  Payload ID: 9371
  Gene Symbol: LRPPRC
  Gene Name: leucine-rich pentatricopeptide repeat containing
  ENST ID: ENST00000447246
  CDS Start-End: 133-1209
gtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccgggtgagtgcccaggccctttctccagaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacg

SEQ ID NO: 148341 - DNA, 888 bp, Homo sapiens
  Payload ID: 9371
  Gene Symbol: LRPPRC
  Gene Name: leucine-rich pentatricopeptide repeat containing
  ENST ID: ENST00000419884
  CDS Start-End: 1-234
gtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgaaaaatgaaaagcttttttgatgttgagctgatgatcttgatgttgatgtagatttctacataattgacatgtccctctccacaacagttcctggattatcttgatttcacagtggttttaagccaaaggggattgaatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattccttta

SEQ ID NO: 148342 - DNA, 5206 bp, Homo sapiens
  Payload ID: 9372
  Gene Symbol: LGR4
  Gene Name: leucine-rich repeat containing G protein-coupled receptor 4
  Uniprot ID: Q9BXB1
  ENST ID: ENST00000379214
  CDS Start-End: 445-3300
ccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcgtgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttagacttgaattataataacttgggggaatttcctcaggctattaaagcccttcctagccttaaagagctaggatttcatagtaattctatttctgttatccctgatggagcatttgatggtaatccactcttaagaactatacatttgtatgataatcctctgtcttttgtggggaactcagcatttcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcctgaatgggctaaatcaactgaaacttgtgggcaacttcaagctgaaagaagccttagcagcaaaagactttgttaacctcaggtctttatcagtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaaactatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaacttttcattttattcatttaaaaactagaataacagatatataaaagtgttaatctttgtgctatatggtatgaaatacaatattgtactcagtgttttgaattattaaagtttctagaaagcaa

SEQ ID NO: 148343 - DNA, 5163 bp, Homo sapiens
  Payload ID: 9372
  Gene Symbol: LGR4
  Gene Name: leucine-rich repeat containing G protein-coupled receptor 4
  Uniprot ID: Q9BXB1
  ENST ID: ENST00000389858
  CDS Start-End: 474-3257
agaagggaaaaggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcgtgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttagacttgaattataataacttgggggaatttcctcaggctattaaagcccttcctagccttaaagagctaggatttcatagtaattctatttctgttatccctgatggagcatttgatggtaatccactcttaagaactatacatttgtatgataatcctctgtcttttgtggggaactcagcatttcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcctgaatgggctaaatcaactgaaacttgtgggcaacttcaagctgaaagaagccttagcagcaaaagactttgttaacctcaggtctttatcagtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaaactatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaacttttcattttattcatttaaaaactagaataacagatatataaaagtgttaatctttgtgctatatggtatgaaatacaatattgtactcagtgttttgaattattaaagtttctagaaagcaa

SEQ ID NO: 148344 - DNA, 492 bp, Homo sapiens
  Payload ID: 9372
  Gene Symbol: LGR4
  Gene Name: leucine-rich repeat containing G protein-coupled receptor 4
  ENST ID: ENST00000480977
  CDS Start-End: 13-489
gcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgtaagta

SEQ ID NO: 148345 - DNA, 4611 bp, Homo sapiens
  Payload ID: 9373
  Gene Symbol: LGR5
  Gene Name: leucine-rich repeat containing G protein-coupled receptor 5
  Uniprot ID: O75473
  ENST ID: ENST00000266674
  CDS Start-End: 312-3035
aaaaaacgagcgtgcaagcagagatgctgctccacaccgctcaggccgcgagcagcagcaaggcgcaccgccactgtcgccgctgcagccagggctgctccgaaggccggcgtggcggcaaccggcacctctgtccccgccgcgcttctcctcgccgcccacgccgtggggtcaggaacgcggcgtctggcgctgcagacgcccgctgagttgcagaagcccacggagcggcgcccggcgcgccacggcccgtagcagtccggtgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccagtttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaaaaccaaaaaagaatctctcagttagtaagaaaaggctgaaaacctcttgatacttgagagtgaatataagtctaaatgctgctttgtataatttgttcagctaagggatagatcgatcacactatttaagtgagcccagatcaaaaaagcagattgaaattttctttagaaaagattctccatgatttgaattgcattctctttaaactcaccaatgtaatcattttgggaggagggagaacccacttgctttccaaatgggtttatttaaacccacaaactcaagaggttgttgggggaattaggaaaataagggttttcaatgacctacattgctaggtagaggctgtgatccatgggatttcattctaatgaccatgtgaagatgtttgagtcctcctttgcctttcctcagaaagaatccttctaaggcacaaatcccttagatggataatgtaaggtattgttaactcactcatattgagatcatttttagagataccaggttttatgtatcagcactagatggttccaccctcatgggataaaactgcttacaagtattttgaaagaaaaactgaccaaaattcttaaattgttactaaggcaatcatgcacaggtgacgtatgtcttatctgatttgtttttaactccttggtgcccaaagctcagaagggaattccactgccagcaatgaacatacctggaaaagaaagtaagcaatctgggattttttttctgggttagtaaagaatttttgcaataagttttatcagttgattcaaactgatgtgcatcttaatgatcaaatgtgcacattacataaattaagtccactgatacaacttcttacacatgtatctctagtagctctggcaaacccaatatctgacaccactttggactcaagagactcagtaacgtattatcctgtttatttagcttggttttagctgtgttctctctggataacccacttgatgttaggaacattacttctctgcttattccatattaatactgtgttaggtattttaagaagcaagttattaaataagaaaagtcaaagtattaattcttaccttctattatcctatattagcttcaatacatccaaaccaaatggctgttaggtagatttatttttatataagcatgtttattttgatcagatgttttaacttggatttgaaaaaatacatttatgagatgttttataagatgtgtaaatatagaactgtatttattactatagtaaaggttcagtaacattaaggaccatgataatgataataaaccttgtacagtggcatattctttgatttatattgtgtttctctgcccattttctttaaattcattaactgtatatatgtaaatatatagtacttgtaaatagattccaaatttgcttttctattgggtaaaaaataaatttgtaataaaatgtgtgactatgaaacaaaa

SEQ ID NO: 148346 - DNA, 2800 bp, Homo sapiens
  Payload ID: 9373
  Gene Symbol: LGR5
  Gene Name: leucine-rich repeat containing G protein-coupled receptor 5
  Uniprot ID: O75473
  ENST ID: ENST00000540815
  CDS Start-End: 47-2698
ctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactacatttctatgacaatcccatccagtttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcgg

SEQ ID NO: 148347 - DNA, 2664 bp, Homo sapiens
  Payload ID: 9373
  Gene Symbol: LGR5
  Gene Name: leucine-rich repeat containing G protein-coupled receptor 5
  Uniprot ID: O75473
  ENST ID: ENST00000536515
  CDS Start-End: 49-2556
tgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccagtttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaa

SEQ ID NO: 148348 - DNA, 3406 bp, Homo sapiens
  Payload ID: 9374
  Gene Symbol: LGR6
  Gene Name: leucine-rich repeat containing G protein-coupled receptor 6
  Uniprot ID: Q9HBX8
  ENST ID: ENST00000255432
  CDS Start-End: 85-2832
gaacgcttgtgtctaactgatgctcctaatgcggaagcccctgaaaggcggttgtggtgcaaaggaaaacccacaggccaaggaatgggaagaccaaggttgacacttgtttgtcaagtgtcaataatcatctctgcccgggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctgcgcctagatgccaacctcatctccctggtcccggagaggagctttgaggggctgtcctccctccgccacctctggctggacgacaatgcactcacggagatccctgtcagggccctcaacaacctccctgccctgcaggccatgaccctggccctcaaccgcatcagccacatccccgactacgcgttccagaatctcaccagccttgtggtgctgcatttgcataacaaccgcatccagcatctggggacccacagcttcgaggggctgcacaatctggagacactagacctgaattataacaagctgcaggagttccctgtggccatccggaccctgggcagactgcaggaactggggttccataacaacaacatcaaggccatcccagaaaaggccttcatggggaaccctctgctacagacgatacacttttatgataacccaatccagtttgtgggaagatcggcattccagtacctgcctaaactccacacactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaatcggcctccaacacaaccgcatctgggaaattggagctgacaccttcagccagctgagctccctgcaagccctggatcttagctggaacgccatccggtccatccaccccgaggccttctccaccctgcactccctggtcaagctggacctgacagacaaccagctgaccacactgcccctggctggacttgggggcttgatgcatctgaagctcaaagggaaccttgctctctcccaggccttctccaaggacagtttcccaaaactgaggatcctggaggtgccttatgcctaccagtgctgtccctatgggatgtgtgccagcttcttcaaggcctctgggcagtgggaggctgaagaccttcaccttgatgatgaggagtcttcaaaaaggcccctgggcctccttgccagacaagcagagaaccactatgaccaggacctggatgagctccagctggagatggaggactcaaagccacaccccagtgtccagtgtagccctactccaggccccttcaagccctgtgagtacctctttgaaagctggggcatccgcctggccgtgtgggccatcgtgttgctctccgtgctctgcaatggactggtgctgctgaccgtgttcgctggcgggcctgtccccctgcccccggtcaagtttgtggtaggtgcgattgcaggcgccaacaccttgactggcatttcctgtggccttctagcctcagtcgatgccctgacctttggtcagttctctgagtacggagcccgctgggagacggggctaggctgccgggccactggcttcctggcagtacttgggtcggaggcatcggtgctgctgctcactctggccgcagtgcagtgcagcgtctccgtctcctgtgtccgggcctatgggaagtccccctccctgggcagcgttcgagcaggggtcctaggctgcctggcactggcagggctggccgccgcgctgcccctggcctcagtgggagaatacggggcctccccactctgcctgccctacgcgccacctgagggtcagccagcagccctgggcttcaccgtggccctggtgatgatgaactccttctgtttcctggtcgtggccggtgcctacatcaaactgtactgtgacctgccgcggggcgactttgaggccgtgtgggactgcgccatggtgaggcacgtggcctggctcatcttcgcagacgggctcctctactgtcccgtggccttcctcagctttgcctccatgctgggcctcttccctgtcacgcccgaggccgtcaagtctgtcctgctggtggtgctgcccctgcctgcctgcctcaacccactgctgtacctgctcttcaacccccacttccgggatgaccttcggcggcttcggccccgcgcaggggactcagggcccctagcctatgctgcggccggggagctggagaagagctcctgtgattctacccaggccctggtagccttctctgatgtggatctcattctggaagcttctgaagctgggcggccccctgggctggagacctatggcttcccctcagtgaccctcatctcctgtcagcagccaggggcccccaggctggagggcagccattgtgtagagccagaggggaaccactttgggaacccccaaccctccatggatggagaactgctgctgagggcagagggatctacgccagcaggtggaggcttgtcagggggtggcggctttcagccctctggcttggcctttgcttcacacgtgtaaatatccctccccattcttctcttcccctctcttccctttcctctctccccctcggtgaatgatggctgcttctaaaacaaatacaaccaaaactcagcagtgtgatctatagcaggatggcccagtccctggctccactgatcacctctctcctgtgaccatcaccaacgggtgcctcttggcctggctttcccttggccttcctcagcttcaccttgatactgggcctcttccttgtcatgtctgaagctgtggaccagagacctggacttttgtctgcttaagggaaatgagggaagtaaagacagtgaaggggtggagggttgatcagggcacagtggacagggagacctcacagagaaaggcctggaaggtgatttcccgtgtgactcatggataggatacaaaatgtgttccatgtaccattaatcttgacatatgccatgcataaagacttcctattaaaataagctttggaagagattacacatgatgtctttttcttagagattcacagtgcatgttagtgtaataaagagataagtcctacagtagtaaaatctattgaactttg

SEQ ID NO: 148349 - DNA, 3567 bp, Homo sapiens
  Payload ID: 9374
  Gene Symbol: LGR6
  Gene Name: leucine-rich repeat containing G protein-coupled receptor 6
  Uniprot ID: Q9HBX8
  ENST ID: ENST00000367278
  CDS Start-End: 90-2993
gcccgccgggaccgggaggaagcagctgcggccatcgcgccgtgcgtccgcgcccggccgccaggtgccccagtagcccgaccgccgagatgcccagcccgccggggctccgggcgctatggctttgcgccgcgctgtgcgcttcccggagggccggcggcgccccccagcccggcccggggcccaccgcctgcccggccccctgccactgccaggaggacggcatcatgctgtctgccgactgctctgagctcgggctgtccgccgttccgggggacctggaccccctgacggcttacctggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctgcgcctagatgccaacctcatctccctggtcccggagaggagctttgaggggctgtcctccctccgccacctctggctggacgacaatgcactcacggagatccctgtcagggccctcaacaacctccctgccctgcaggccatgaccctggccctcaaccgcatcagccacatccccgactacgcgttccagaatctcaccagccttgtggtgctgcatttgcataacaaccgcatccagcatctggggacccacagcttcgaggggctgcacaatctggagacactagacctgaattataacaagctgcaggagttccctgtggccatccggaccctgggcagactgcaggaactggggttccataacaacaacatcaaggccatcccagaaaaggccttcatggggaaccctctgctacagacgatacacttttatgataacccaatccagtttgtgggaagatcggcattccagtacctgcctaaactccacacactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaatcggcctccaacacaaccgcatctgggaaattggagctgacaccttcagccagctgagctccctgcaagccctggatcttagctggaacgccatccggtccatccaccccgaggccttctccaccctgcactccctggtcaagctggacctgacagacaaccagctgaccacactgcccctggctggacttgggggcttgatgcatctgaagctcaaagggaaccttgctctctcccaggccttctccaaggacagtttcccaaaactgaggatcctggaggtgccttatgcctaccagtgctgtccctatgggatgtgtgccagcttcttcaaggcctctgggcagtgggaggctgaagaccttcaccttgatgatgaggagtcttcaaaaaggcccctgggcctccttgccagacaagcagagaaccactatgaccaggacctggatgagctccagctggagatggaggactcaaagccacaccccagtgtccagtgtagccctactccaggccccttcaagccctgtgagtacctctttgaaagctggggcatccgcctggccgtgtgggccatcgtgttgctctccgtgctctgcaatggactggtgctgctgaccgtgttcgctggcgggcctgtccccctgcccccggtcaagtttgtggtaggtgcgattgcaggcgccaacaccttgactggcatttcctgtggccttctagcctcagtcgatgccctgacctttggtcagttctctgagtacggagcccgctgggagacggggctaggctgccgggccactggcttcctggcagtacttgggtcggaggcatcggtgctgctgctcactctggccgcagtgcagtgcagcgtctccgtctcctgtgtccgggcctatgggaagtccccctccctgggcagcgttcgagcaggggtcctaggctgcctggcactggcagggctggccgccgcgctgcccctggcctcagtgggagaatacggggcctccccactctgcctgccctacgcgccacctgagggtcagccagcagccctgggcttcaccgtggccctggtgatgatgaactccttctgtttcctggtcgtggccggtgcctacatcaaactgtactgtgacctgccgcggggcgactttgaggccgtgtgggactgcgccatggtgaggcacgtggcctggctcatcttcgcagacgggctcctctactgtcccgtggccttcctcagctttgcctccatgctgggcctcttccctgtcacgcccgaggccgtcaagtctgtcctgctggtggtgctgcccctgcctgcctgcctcaacccactgctgtacctgctcttcaacccccacttccgggatgaccttcggcggcttcggccccgcgcaggggactcagggcccctagcctatgctgcggccggggagctggagaagagctcctgtgattctacccaggccctggtagccttctctgatgtggatctcattctggaagcttctgaagctgggcggccccctgggctggagacctatggcttcccctcagtgaccctcatctcctgtcagcagccaggggcccccaggctggagggcagccattgtgtagagccagaggggaaccactttgggaacccccaaccctccatggatggagaactgctgctgagggcagagggatctacgccagcaggtggaggcttgtcagggggtggcggctttcagccctctggcttggcctttgcttcacacgtgtaaatatccctccccattcttctcttcccctctcttccctttcctctctccccctcggtgaatgatggctgcttctaaaacaaatacaaccaaaactcagcagtgtgatctatagcaggatggcccagtccctggctccactgatcacctctctcctgtgaccatcaccaacgggtgcctcttggcctggctttcccttggccttcctcagcttcaccttgatactgggcctcttccttgtcatgtctgaagctgtggaccagagacctggacttttgtctgcttaagggaaatgagggaagtaaagacagtgaaggggtggagggttgatcagggcacagtggacagggagacctcacagagaaaggcctggaaggtgatttcccgtgtgactcatggataggatacaaaatgtgttccatgtaccattaatcttgacatatgccatgcataaagacttcctattaaaataagctttggaagagattacacatgatgtctttttcttagagattcacagtgcatgttagtgtaataaagagataagtcctacagtagtaaaatctattgaactttg

SEQ ID NO: 148350 - DNA, 2487 bp, Homo sapiens
  Payload ID: 9374
  Gene Symbol: LGR6
  Gene Name: leucine-rich repeat containing G protein-coupled receptor 6
  Uniprot ID: Q9HBX8
  ENST ID: ENST00000439764
  CDS Start-End: 1-2487
atgcgcttggagggagagggccgctcagcgagggcgggacagaacctctcccgggctgggagtgcacggcgcggtgcgcccagggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctagacctgaattataacaagctgcaggagttccctgtggccatccggaccctgggcagactgcaggaactggggttccataacaacaacatcaaggccatcccagaaaaggccttcatggggaaccctctgctacagacgatacacttttatgataacccaatccagtttgtgggaagatcggcattccagtacctgcctaaactccacacactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaatcggcctccaacacaaccgcatctgggaaattggagctgacaccttcagccagctgagctccctgcaagccctggatcttagctggaacgccatccggtccatccaccccgaggccttctccaccctgcactccctggtcaagctggacctgacagacaaccagctgaccacactgcccctggctggacttgggggcttgatgcatctgaagctcaaagggaaccttgctctctcccaggccttctccaaggacagtttcccaaaactgaggatcctggaggtgccttatgcctaccagtgctgtccctatgggatgtgtgccagcttcttcaaggcctctgggcagtgggaggctgaagaccttcaccttgatgatgaggagtcttcaaaaaggcccctgggcctccttgccagacaagcagagaaccactatgaccaggacctggatgagctccagctggagatggaggactcaaagccacaccccagtgtccagtgtagccctactccaggccccttcaagccctgtgagtacctctttgaaagctggggcatccgcctggccgtgtgggccatcgtgttgctctccgtgctctgcaatggactggtgctgctgaccgtgttcgctggcgggcctgtccccctgcccccggtcaagtttgtggtaggtgcgattgcaggcgccaacaccttgactggcatttcctgtggccttctagcctcagtcgatgccctgacctttggtcagttctctgagtacggagcccgctgggagacggggctaggctgccgggccactggcttcctggcagtacttgggtcggaggcatcggtgctgctgctcactctggccgcagtgcagtgcagcgtctccgtctcctgtgtccgggcctatgggaagtccccctccctgggcagcgttcgagcaggggtcctaggctgcctggcactggcagggctggccgccgcgctgcccctggcctcagtgggagaatacggggcctccccactctgcctgccctacgcgccacctgagggtcagccagcagccctgggcttcaccgtggccctggtgatgatgaactccttctgtttcctggtcgtggccggtgcctacatcaaactgtactgtgacctgccgcggggcgactttgaggccgtgtgggactgcgccatggtgaggcacgtggcctggctcatcttcgcagacgggctcctctactgtcccgtggccttcctcagctttgcctccatgctgggcctcttccctgtcacgcccgaggccgtcaagtctgtcctgctggtggtgctgcccctgcctgcctgcctcaacccactgctgtacctgctcttcaacccccacttccgggatgaccttcggcggcttcggccccgcgcaggggactcagggcccctagcctatgctgcggccggggagctggagaagagctcctgtgattctacccaggccctggtagccttctctgatgtggatctcattctggaagcttctgaagctgggcggccccctgggctggagacctatggcttcccctcagtgaccctcatctcctgtcagcagccaggggcccccaggctggagggcagccattgtgtagagccagaggggaaccactttgggaacccccaaccctccatggatggagaactgctgctgagggcagagggatctacgccagcaggtggaggcttgtcagggggtggcggctttcagccctctggcttggcctttgcttcacacgtgtaa

SEQ ID NO: 148351 - DNA, 792 bp, Homo sapiens
  Payload ID: 9374
  Gene Symbol: LGR6
  Gene Name: leucine-rich repeat containing G protein-coupled receptor 6
  ENST ID: ENST00000423542
  CDS Start-End: 95-792
tcctattcattctcttgattttttttaaagaaaacttcttttgaaaatttccatccaattccaaacaagctaggacgaacaaagggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctgcgcctagatgccaacctcatctccctggtcccggagaggagctttgaggggctgtcctccctccgccacctctggctggacgacaatgcactcacggagatccctgtcagggccctcaacaacctccctgccctgcaggccatgaccctggccctcaaccgcatcagccacatccccgactacgcgttccagaatctcaccagccttgtggtgctagacctgaattataacaagctgcaggagttccctgtggccatccggaccctgggcagactgcaggaactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaat

SEQ ID NO: 148352 - DNA, 3377 bp, Homo sapiens
  Payload ID: 9374
  Gene Symbol: LGR6
  Gene Name: leucine-rich repeat containing G protein-coupled receptor 6
  ENST ID: ENST00000487787
  CDS Start-End: 44-1090
tgaaaggcggttgtggtgcaaaggaaaacccacaggccaaggaatgggaagaccaaggttgacacttgtttgtcaagtgtcaataatcatctctgcccgggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctgcgcctagatgccaacctcatctccctggtcccggagaggagctttgaggggctgtcctccctccgccacctctggctggacgacaatgcactcacggagatccctgtcagggccctcaacaacctccctgccctgcaggccatgaccctggccctcaaccgcatcagccacatccccgactacgcgttccagaatctcaccagccttgtggtgctgcatttgcataacaaccgcatccagcatctggggacccacagcttcgaggggctgcacaatctggagacactagacctgaattataacaagctgcaggagttccctgtggccatccggaccctgggcagactgcaggaactggggttccataacaacaacatcaaggccatcccagaaaaggccttcatggggaaccctctgctacagacgatacacttttatgataacccaatccagtttgtgggaagatcggcattccagtacctgcctaaactccacacactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaatgagaagtggggggctctactttcttcctcccagtgctcggggggcatggagcggagccagggtctgagcctgccggctcatccagcctctcttgctgccctagcggcctccaacacaaccgcatctgggaaattggagctgacaccttcagccagctgagctccctgcaagccctggatcttagctggaacgccatccggtccatccaccccgaggccttctccaccctgcactccctggtcaagctggacctgacagacaaccagctgaccacactgcccctggctggacttgggggcttgatgcatctgaagctcaaagggaaccttgctctctcccaggccttctccaaggacagtttcccaaaactgaggatcctggaggtgccttatgcctaccagtgctgtccctatgggatgtgtgccagcttcttcaaggcctctgggcagtgggaggctgaagaccttcaccttgatgatgaggagtcttcaaaaaggcccctgggcctccttgccagacaagcagagaaccactatgaccaggacctggatgagctccagctggagatggaggactcaaagccacaccccagtgtccagtgtagccctactccaggccccttcaagccctgtgagtacctctttgaaagctggggcatccgcctggccgtgtgggccatcgtgttgctctccgtgctctgcaatggactggtgctgctgaccgtgttcgctggcgggcctgtccccctgcccccggtcaagtttgtggtaggtgcgattgcaggcgccaacaccttgactggcatttcctgtggccttctagcctcagtcgatgccctgacctttggtcagttctctgagtacggagcccgctgggagacggggctaggctgccgggccactggcttcctggcagtacttgggtcggaggcatcggtgctgctgctcactctggccgcagtgcagtgcagcgtctccgtctcctgtgtccgggcctatgggaagtccccctccctgggcagcgttcgagcaggggtcctaggctgcctggcactggcagggctggccgccgcgctgcccctggcctcagtgggagaatacggggcctccccactctgcctgccctacgcgccacctgagggtcagccagcagccctgggcttcaccgtggccctggtgatgatgaactccttctgtttcctggtcgtggccggtgcctacatcaaactgtactgtgacctgccgcggggcgactttgaggccgtgtgggactgcgccatggtgaggcacgtggcctggctcatcttcgcagacgggctcctctactgtcccgtggccttcctcagctttgcctccatgctgggcctcttccctgtcacgcccgaggccgtcaagtctgtcctgctggtggtgctgcccctgcctgcctgcctcaacccactgctgtacctgctcttcaacccccacttccgggatgaccttcggcggcttcggccccgcgcaggggactcagggcccctagcctatgctgcggccggggagctggagaagagctcctgtgattctacccaggccctggtagccttctctgatgtggatctcattctggaagcttctgaagctgggcggccccctgggctggagacctatggcttcccctcagtgaccctcatctcctgtcagcagccaggggcccccaggctggagggcagccattgtgtagagccagaggggaaccactttgggaacccccaaccctccatggatggagaactgctgctgagggcagagggatctacgccagcaggtggaggcttgtcagggggtggcggctttcagccctctggcttggcctttgcttcacacgtgtaaatatccctccccattcttctcttcccctctcttccctttcctctctccccctcggtgaatgatggctgcttctaaaacaaatacaaccaaaactcagcagtgtgatctatagcaggatggcccagtccctggctccactgatcacctctctcctgtgaccatcaccaacgggtgcctcttggcctggctttcccttggccttcctcagcttcaccttgatactgggcctcttccttgtcatgtctgaagctgtggaccagagacctggacttttgtctgcttaagggaaatgagggaagtaaagacagtgaaggggtggagggttgatcagggcacagtggacagggagacctcacagagaaaggcctggaaggtgatttcccgtgtgactcatggataggatacaaaatgtgttccatgtaccattaatcttgacatatgccatgcataaagacttcctattaaaataagctttggaagaga

SEQ ID NO: 148353 - DNA, 7671 bp, Homo sapiens
  Payload ID: 9375
  Gene Symbol: LRRK1
  Gene Name: leucine-rich repeat kinase 1
  Uniprot ID: Q38SD2
  ENST ID: ENST00000388948
  CDS Start-End: 360-6407
gcggccgccgaggggacgcctcgcgacggttcctgggagagctggcggcggccttgctctgcgcgctcttcgcgccgccctccccgcccgcccgcctcaggattgaggaagtgcgtctgggcccggccccggcgcggggggcagacggcggtgggacggccaggccccggccccgccagtgtgtccgcccggccccgcgtcccggagcgcccgcacccggccccgccgccgcctcagagcaagaaagctttctgctcagccatggctacgagtccacgccttaatgcaccccacagccagcggcagtggcagtgacaacagcgggacctgcctttgaagatcggctgctgcaagggttgatggctggcatgtcgcaaagaccccccagcatgtactggtgtgtggggccggaggagtcagctgtgtgtccagaacgtgccatggagacgcttaacggtgccggggacacgggcggcaagccgtccacgcggggcggtgaccctgcagcgcggtcccgcaggacggaaggcatccgcgccgcgtacaggcggggagaccgcggcggcgcccgggacctgctggaggaggcctgcgaccagtgcgcgtcccagctggaaaagggccagcttctgagcatcccggcagcctatggggatctggagatggtccgctacctactcagcaagagactggtggagctgcccaccgagcccacggatgacaacccagccgtggtggcagcgtattttggacacacggcagttgtgcaggaattgcttgagtccttaccaggtccctgcagtccccagcggcttctgaactggatgctggccttggcttgccagcgagggcacctgggggttgtgaagctcctggtcctgacgcacggggctgacccggagagctacgctgtcaggaagaatgagttccctgtcatcgtgcgcttgcccctgtatgcggccatcaagtcagggaatgaagacattgcaatattcctgcttcggcatggggcctatttctgttcctacatcttgctggatagtcctgaccccagcaaacatctgctgagaaagtacttcattgaagccagtcccttgcccagcagttatccgggaaaaacagctctccgtgtgaaatggtcccatctcagactgccctgggtagacctagactggctcatagacatctcctgccagatcacggagctcgacctttctgccaactgcctggcgaccctcccctcggttatcccctggggcctcatcaatctccggaagctgaacctctccgacaaccacctgggggagctgcctggcgtgcagtcatcggacgaaatcatctgttccaggctacttgaaattgacatttccagcaacaagttgtcccacctccctcctggattcttgcacctctcaaaacttcaaaaactgacagcttcaaaaaattgtttagaaaaattgttcgaagaagaaaatgccactaactggataggtttacggaagctacaggaacttgatatatctgacaataaattgacagaactccctgccctgttccttcactctttcaagtccctcaattctctgaatgtctccagaaacaacctgaaggtgtttccagatccctgggcctgccctttgaaatgttgtaaagcttccagaaatgccctggaatgtctgccagacaaaatggctgtcttttggaaaaatcacctgaaggatgtggatttctcagaaaacgcactcaaagaagttcccctgggacttttccagcttgatgccctcatgttcttgaggttacaggggaaccagctggcggcacttccacctcaagagaagtggacctgcaggcagctcaaaaccctggatctctccagaaaccaacttggcaaaaatgaagatggactgaaaacgaagcgtattgcctttttcaccaccagaggtcgccagcgctccgggactgaggcagcaagtgtgctggaatttccggccttcctaagtgagtctttggaagtcctttgcctgaacgacaaccacctcgacacagtccctccctcggtttgcctactgaagagcttatcagagctctacttgggaaacaaccctggcctccgggagctccctcctgagctggggcagctgggcaacctctggcagctggacactgaagacctgaccatcagcaatgtgcctgcagaaatccaaaaagaaggccccaaagcaatgctgtcttacctgcgtgctcagctgcggaaagcggaaaagtgcaagctgatgaagatgatcatcgtgggtcccccgcgccagggcaagtccaccctcctggagatcttacagacggggagggccccccaggtggtgcatggagaggccaccatcaggaccaccaagtgggagctccagaggccggctggctcgagagccaaggttgagtccgtggagttcaacgtctgggacatcgggggaccggccagcatggccactgtcaaccagtgcttcttcacggacaaggccctgtacgtggtggtctggaacctggcgctgggggaggaggccgtggccaacctccagttctggctgctcaacatcgaggccaaggccccaaacgccgtggtgctggtggtcgggacgcacctggatttaattgaagccaagttccgtgtggaaaggattgcaacgctgcgtgcctatgtgctggcactctgccgctccccctccggctccagggccacaggcttcccagacatcaccttcaaacacttacatgagatttcctgcaagagcctggaaggtcaggaagggctgcgacagctgattttccacgtcacgtgcagcatgaaggacgtgggcagcaccatcggctgccagcgactggcagggcggctgatccccaggagctacctgagcctgcaggaggccgtgctggcagagcagcagcgccgcagccgggacgacgacgtgcagtacctgacggacaggcagctggagcagctggtggagcagacgcccgacaacgacatcaaggactacgaggacctgcagtcagccatcagcttcctcatagaaaccggcaccctgctccatttcccggacaccagccacggcctgaggaacctctacttcctcgaccctatttggctctccgaatgtctgcagaggatctttaatattaagggctctcggtcagtggccaagaatggggtgatcagagcagaagacctcaggatgctgctggtggggactggcttcacgcagcagacggaagagcagtacttccagttcctggccaagtttgagatcgccctgcccgtcgccaatgacagctacctcctgccccatctccttccatctaaacctggcctggacacccacggtatgcggcaccccacagccaacaccattcagagggtatttaagatgagcttcgttcccgttggcttctggcaaaggtttatagcacggatgctgatcagcctggcggagatggacctgcagctttttgaaaacaagaagaatactaaaagcaggaacaggaaagtcaccatttacagttttacaggaaaccagagaaatcgctgtagcacattcagagtgaaaagaaatcagaccatctattggcaggaagggctcctggtcacttttgatgggggctacctcagtgtggaatcttccgacgtgaactggaaaaagaagaaaagcggaggaatgaaaattgtttgccaatcagaagtgagggacttctcagccatggctttcatcacggaccacgtcaattccttgattgatcagtggtttcccgccctgacagccacagagagcgacgggacgccactcatggagcagtacgtgccctgcccggtctgcgagacagcctgggcccagcacacggaccccagtgagaaatcagaggatgtgcagtacttcgacatggaagactgtgtcctgacggccatcgagcgggacttcatctcctgccccagacacccggacctccccgtgccgctgcaggagctggtccctgaactgttcatgaccgacttcccggccaggctcttcctggagaacagcaagctggagcacagcgaggacgagggcagcgtcctgggccagggcggcagtggcaccgtcatctaccgggcccggtaccagggccagcctgtggccgtcaagcgcttccacatcaaaaaattcaagaactttgctaacgtaccggcagacaccatgctgaggcacctgcgggccaccgatgccatgaagaacttctccgagttccggcaggaggccagcatgctgcacgcgctgcagcacccctgcatcgtggcgctcatcggcatcagcatccacccgctctgcttcgccctggagctcgcgccgctcagcagcctcaacaccgtgctgtccgagaacgccagagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctggcgcccagcggggccgagtcattgccgtcttaaaagcccgagagctgactccgcatggggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaagaacgaa

SEQ ID NO: 148354 - DNA, 6015 bp, Homo sapiens
  Payload ID: 9375
  Gene Symbol: LRRK1
  Gene Name: leucine-rich repeat kinase 1
  ENST ID: ENST00000531270
  CDS Start-End: 31-1983
gcctttgaagatcggctgctgcaagggttgatggctggcatgtcgcaaagaccccccagcatgtactggtgtgtggggccggaggagtcagctgtgtgtccagaacgtgccatggagacgcttaacggtgccggggacacgggcggcaagccgtccacgcggggcggtgaccctgcagcgcggtcccgcaggacggaaggcatccgcgccgcgtacaggcggggagaccgcggcggcgcccgggacctgctggaggaggcctgcgaccagtgcgcgtcccagctggaaaagggccagcttctgagcatcccggcagcctatggggatctggagatggtccgctacctactcagcaagagactggtggagctgcccaccgagcccacggatgacaacccagccgtggtggcagcgtattttggacacacggcagttgtgcaggaattgcttgagtccttaccaggtccctgcagtccccagcggcttctgaactggatgctggccttggcttgccagcgagggcacctgggggttgtgaagctcctggtcctgacgcacggggctgacccggagagctacgctgtcaggaagaatgagttccctgtcatcgtgcgcttgcccctgtatgcggccatcaagtcagggaatgaagacattgcaatattcctgcttcggcatggggcctatttctgttcctacatcttgctggatagtcctgaccccagcaaacatctgctgagaaagtacttcattgaagccagtcccttgcccagcagttatccgggaaaaacagctctccgtgtgaaatggtcccatctcagactgccctgggtagacctagactggctcatagacatctcctgccagatcacggagctcgacctttctgccaactgcctggcgaccctcccctcggttatcccctggggcctcatcaatctccggaagctgaacctctccgacaaccacctgggggagctgcctggcgtgcagtcatcggacgaaatcatctgttccaggctacttgaaattgacatttccagcaacaagttgtcccacctccctcctggattcttgcacctctcaaaacttcaaaaactgacagcttcaaaaaattgtttagaaaaattgttcgaagaagaaaatgccactaactggataggtttacggaagctacaggaacttgatatatctgacaataaattgacagaactccctgccctgttccttcactctttcaagtccctcaattctctgaatgtctccagaaacaacctgaaggtgtttccagatccctgggcctgccctttgaaatgttgtaaagcttccagaaatgccctggaatgtctgccagacaaaatggctgtcttttggaaaaatcacctgaaggatgtggatttctcagaaaacgcactcaaagaagttcccctgggacttttccagcttgatgccctcatgttcttgaggttacaggggaaccagctggcggcacttccacctcaagagaagtggacctgcaggcagctcaaaaccctggatctctccagaaaccaacttggcaaaaatgaagatggactgaaaacgaagcgtattgcctttttcaccaccagaggtcgccagcgctccgggactgaggcagcaagtgtgctggaatttccggccttcctaagtgagtctttggaagtcctttgcctgaacgacaaccacctcgacacagtccctccctcggtttgcctactgaagagcttatcagagctctacttgggaaacaaccctggcctccgggagctccctcctgagctggggcagctgggcaacctctggcagctggacactgaagacctgaccatcagcaatgtgcctgcagaaatccaaaaagaaggccccaaagcaatgctgtcttacctgcgtgctcagctgcggaaagcggaaaagtgcaagctgatgaagatgatcatcgtgggtcccccgcgccagggttgagtccgtggagttcaacgtctgggacatcgggggaccggccagcatggccactgtcaaccagtgcttcttcacggacaaggccctgtacgtggtggtctggaacctggcgctgggggaggaggccgtggccaacctccagttctggctgctcaacatcgaggccaaggccccaaacgccgtggtgctggtggtcgggacgcacctggatttaattgaagccaagttccgtgtggaaaggattgcaacgctgcgtgcctatgtgctggcactctgccgctccccctccggctccagggccacaggcttcccagacatcaccttcaaacacttacatgagatttcctgcaagagcctggaaggtcaggaagggctgcgacagctgattttccacgtcacgtgcagcatgaaggacgtgggcagcaccatcggctgccagcgactggcagggcggctgatccccaggagctacctgagcctgcaggaggccgtgctggcagagcagcagcgccgcagccgggacgacgacgtgcagtacctgacggacaggcagctggagcagctggtggagcagacgcccgacaacgacatcaaggactacgaggacctgcagtcagccatcagcttcctcatagaaaccggcaccctgctccatttcccggacaccagccacggcctgaggaacctctacttcctcgaccctatttggctctccgaatgtctgcagaggatctttaatattaagggctctcggtcagtggccaagaatggggtgatcagagcagaagacctcaggatgctgctggtggggactggcttcacgcagcagacggaagagcagtacttccagttcctggccaagtttgagatcgccctgcccgtcgccaatgacagctacctcctgccccatctccttccatctaaacctggcctggacacccacggtatgcggcaccccacagccaacaccattcagagggtatttaagatgagcttcgttcccgttggcttctggcaaaggtttatagcacggatgctgatcagcctggcggagatggacctgcagtgtggaatcttccgacgtgaactggaaaaagaagaaaagcggaggaatgaaaattgtttgccaatcagaagtgagggacttctcagccatggctttcatcacggaccacgtcaattccttgattgatcagtggtttcccgccctgacagccacagagagcgacgggacgccactcatggagcagtacgtgccctgcccggtctgcgagacagcctgggcccagcacacggaccccagtgagaaatcagaggatgtgcagtacttcgacatggaagactgtgtcctgacggccatcgagcgggacttcatctcctgccccagacacccggacctccccgtgccgctgcaggagctggtccctgaactgttcatgaccgacttcccggccaggctcttcctggagaacagcaagctggagcacagcgaggacgagggcagcgtcctgggccagggcggcagtggcaccgtcatctaccgggcccggtaccagggccagcctgtggccgtcaagcgcttccacatcaaaaaattcaagaactttgctaacgtaccggcagacaccatgctgaggcacctgcgggccaccgatgccatgaagaacttctccgagttccggcaggaggccagcatgctgcacgcgctgcagcacccctgcatcgtggcgctcatcggcatcagcatccacccgctctgcttcgccctggagctcgcgccgctcagcagcctcaacaccgtgctgtccgagaacgccagagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctggcgcccagcggggccgagtcattgccgtcttaaaagcccgagagctgactccgcatggggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaa

SEQ ID NO: 148355 - DNA, 6494 bp, Homo sapiens
  Payload ID: 9375
  Gene Symbol: LRRK1
  Gene Name: leucine-rich repeat kinase 1
  ENST ID: ENST00000525284
  CDS Start-End: 31-2100
gcctttgaagatcggctgctgcaagggttgatggctggcatgtcgcaaagaccccccagcatgtactggtgtgtggggccggaggagtcagctgtgtgtccagaacgtgccatggagacgcttaacggtgccggggacacgggcggcaagccgtccacgcggggcggtgaccctgcagcgcggtcccgcaggacggaaggcatccgcgccgcgtacaggcggggagaccgcggcggcgcccgggacctgctggaggaggcctgcgaccagtgcgcgtcccagctggaaaagggccagcttctgagcatcccggcagcctatggggatctggagatggtccgctacctactcagcaagagactggtggagctgcccaccgagcccacggatgacaacccagccgtggtggcagcgtattttggacacacggcagttgtgcaggaattgcttgagtccttaccaggtccctgcagtccccagcggcttctgaactggatgctggccttggcttgccagcgagggcacctgggggttgtgaagctcctggtcctgacgcacggggctgacccggagagctacgctgtcaggaagaatgagttccctgtcatcgtgcgcttgcccctgtatgcggccatcaagtcagggaatgaagacattgcaatattcctgcttcggcatggggcctatttctgttcctacatcttgctggatagtcctgaccccagcaaacatctgctgagaaagtacttcattgaagccagtcccttgcccagcagttatccgggaaaaacagctctccgtgtgaaatggtcccatctcagactgccctgggtagacctagactggctcatagacatctcctgccagatcacggagctcgacctttctgccaactgcctggcgaccctcccctcggttatcccctggggcctcatcaatctccggaagctgaacctctccgacaaccacctgggggagctgcctggcgtgcagtcatcggacgaaatcatctgttccaggctacttgaaattgacatttccagcaacaagttgtcccacctccctcctggattcttgcacctctcaaaacttcaaaaactgacagcttcaaaaaattgtttagaaaaattgttcgaagaagaaaatgccactaactggataggtttacggaagctacaggaacttgatatatctgacaataaattgacagaactccctgccctgttccttcactctttcaagtccctcaattctctgaatgtctccagaaacaacctgaaggtgtttccagatccctgggcctgccctttgaaatgttgtaaagcttccagaaatgccctggaatgtctgccagacaaaatggctgtcttttggaaaaatcacctgaaggatgtggatttctcagaaaacgcactcaaagaagttcccctgggacttttccagcttgatgccctcatgttcttgaggttacaggggaaccagctggcggcacttccacctcaagagaagtggacctgcaggcagctcaaaaccctggatctctccagaaaccaacttggcaaaaatgaagatggactgaaaacgaagcgtattgcctttttcaccaccagaggtcgccagcgctccgggactgaggcagcaagtgtgctggaatttccggccttcctaagtgagtctttggaagtcctttgcctgaacgacaaccacctcgacacagtccctccctcggtttgcctactgaagagcttatcagagctctacttgggaaacaaccctggcctccgggagctccctcctgagctggggcagctgggcaacctctggcagctggacactgaagacctgaccatcagcaatgtgcctgcagaaatccaaaaagaaggccccaaagcaatgctgtcttacctgcgtgctcagctgcggaaagcggaaaagtgcaagctgatgaagatgatcatcgtgggtcccccgcgccagggcaagtccaccctcctggagatcttacagacggggagggccccccaggtggtgcatggagaggccaccatcaggaccaccaagtgggagctccagaggccggctggctcgagagccaagtaggttgagtccgtggagttcaacgtctgggacatcgggggaccggccagcatggccactgtcaaccagtgcttcttcacggacaaggccctgtacgtggtggtctggaacctggcgctgggggaggaggccgtggccaacctccagttctggctgctcaacatcgaggccaaggccccaaacgccgtggtgctggtggtcgggacgcacctggatttaattgaagccaagttccgtgtggaaaggattgcaacgctgcgtgcctatgtgctggcactctgccgctccccctccggctccagggccacaggcttcccagacatcaccttcaaacacttacatgagatttcctgcaagagcctggaaggtcaggaagggctgcgacagctgattttccacgtcacgtgcagcatgaaggacgtgggcagcaccatcggctgccagcgactggcagggcggctgatccccaggagctacctgagcctgcaggaggccgtgctggcagagcagcagcgccgcagccgggacgacgacgtgcagtacctgacggacaggcagctggagcagctggtggagcagacgcccgacaacgacatcaaggactacgaggacctgcagtcagccatcagcttcctcatagaaaccggcaccctgctccatttcccggacaccagccacggcctgaggaacctctacttcctcgaccctatttggctctccgaatgtctgcagaggatctttaatattaagggctctcggtcagtggccaagaatggggtgatcagagcagaagacctcaggatgctgctggtggggactggcttcacgcagcagacggaagagcagtacttccagttcctggccaagtttgagatcgccctgcccgtcgccaatgacagctacctcctgccccatctccttccatctaaacctggcctggacacccacggtatgcggcaccccacagccaacaccattcagagggtatttaagatgagcttcgttcccgttggcttctggcaaaggtttatagcacggatgctgatcagcctggcggagatggacctgcagctttttgaaaacaagaagaatactaaaagcaggaacaggaaagtcaccatttacagttttacaggaaaccagagaaatcgctgtagcacattcagagtgaaaagaaatcagaccatctattggcaggaagggctcctggtcacttttgatgggggctacctcagtgtggaatcttccgacgtgaactggaaaaagaagaaaagcggaggaatgaaaattgtttgccaatcagaagtgagggacttctcagccatggctttcatcacggaccacgtcaattccttgattgatcagtggtttcccgccctgacagccacagagagcgacgggacgccactcatggagcagtacgtgccctgcccggtctgcgagacagcctgggcccagcacacggaccccagtgagaaatcagaggatgtgcagtacttcgacatggaagactgtgtcctgacggccatcgagcgggacttcatctcctgccccagacacccggacctccccgtgccgctgcaggagctggtccctgaactgttcatgaccgacttcccggccaggctcttcctggagaacagcaagctggagcacagcgaggacgagggcagcgtcctgggccagggcggcagtggcaccgtcatctaccgggcccggtaccagggccagcctgtggccgtcaagcgcttccacatcaaaaaattcaagaactttgctaacgtaccggcagacaccatgctgaggcacctgcgggccaccgatgccatgaagaacttctccgagttccggcaggaggccagcatgctgcacgcgctgcagcacccctgcatcgtggcgctcatcggcatcagcatccacccgctctgcttcgccctggagctcgcgccgctcagcagcctcaacaccgtgctgtccgagaacgccagagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgagactagtctgtctttttcaacgtttctacaaagagcagaaatccataaacaacccaccagaacgtgtcaatccatgtaactttccaagacccataggggatccccaagtccaagtgcatcctcatgggaatggcttgggaaatgccagacactttccagcctgggtctcacagtggacctgtctgcctctgcaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctggcgcccagcggggccgagtcattgccgtcttaaaagcccgagagctgactccgcatggggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaa

SEQ ID NO: 148356 - DNA, 1241 bp, Homo sapiens
  Payload ID: 9375
  Gene Symbol: LRRK1
  Gene Name: leucine-rich repeat kinase 1
  Uniprot ID: Q38SD2
  ENST ID: ENST00000532029
  CDS Start-End: 230-1024
ggcgcggggggcagacggcggtgggacggccaggccccggccccgccagtgtgtccgcccggccccgcgtcccggagcgcccgcacccggccccgccgccgcctcagagcaagaaagctttctgctcagccatggctacgagtccacgccttaatgcaccccacagccagcggcagtggcagtgacaacagcgggacctgcctttgaagatcggctgctgcaagggttgatggctggcatgtcgcaaagaccccccagcatgtactggtgtgtggggccggaggagtcagctgtgtgtccagaacgtgccatggagacgcttaacggtgccggggacacgggcggcaagccgtccacgcggggcggtgaccctgcagcgcggtcccgcaggacggaaggcatccgcgccgcgtacaggcggggagaccgcggcggcgcccgggacctgctggaggaggcctgcgaccagtgcgcgtcccagctggaaaagggccagcttctgagcatcccggcagcctatggggatctggagatggtccgctacctactcagcaagagactggtggagctgcccaccgagcccacggatgacaacccagccgtggtggcagcgtattttggacacacggcagttgtgcaggaattgcttgagtccttaccaggtccctgcagtccccagcggcttctgaactggatgctggccttggcttgccagcgagggcacctgggggttgtgaagctcctggtcctgacgcacggggctgacccggagagctacgctgtcaggaagaatgagttccctgtcatcgtgcgcttgcccctgtatgcggccatcaagtcagggaatgaagacattgcaatattcctgcttcggcatggggcctatttctgttcctacatcttgctggatagtcctgaccccagcaaacatctgctgagaaagtacttcattgaagccagtcccttgcccagcagttatccgggaaaaacagtgagtagtcactgcctgtggagtgtgttttagttccttttgtgctgctgtaacagaatcctgcagactgggtaatttataataaacagaaatatatttggcttacaggtctggagattgagaagtccaagagcatagtgctggtatctggtgagggccttcatgcagtgatatgaaggtggagggcaagagaccaacagactgagagagggaagaactcacttttataacaacccaccctcaaaataac

SEQ ID NO: 148357 - DNA, 569 bp, Homo sapiens
  Payload ID: 9375
  Gene Symbol: LRRK1
  Gene Name: leucine-rich repeat kinase 1
  ENST ID: ENST00000534045
  CDS Start-End: 473-569
gcgtctgggcccggccccggcgcggggggcagacggcggtgggacggccaggccccggccccgccagtgtgtccgcccggccccgcgtcccggagcgcccgcacccggccccgccgccgcctcaggtggtctctggctggcgcagatacaactgctctgtctaccatggtctctgcaagctacaggggaccttcctggcaggcagggacgcgggaaggaagcctaggaaggccggggtcagcgaggagacgctggtggagaatctgagaacccccgtggccatctcaacctaccccttcacagtatgaggccgcgaagtttttctcccacgaacacttcccctgcaacagagcaagaaagctttctgctcagccatggctacgagtccacgccttaatgcaccccacagccagcggcagtggcagtgacaacagcgggacctgcctttgaagatcggctgctgcaagggttgatggctggcatgtcgcaaagaccccccagcatgtactggtgtgtggggccggaggagtcagctgtgtgtccagaacgtgccatggagacgcttaacg

SEQ ID NO: 148358 - DNA, 11632 bp, Homo sapiens
  Payload ID: 9375
  Gene Symbol: LRRK1
  Gene Name: leucine-rich repeat kinase 1
  ENST ID: ENST00000526457
  CDS Start-End: 1-1982
gcatcagcatccacccgctctgcttcgccctggagctcgcgccgctcagcagcctcaacaccgtgctgtccgagaacgccagagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctggcgcccagcggggccgagtcattgccgtcttaaaagcccgagagctgactccgcatgggattatgccagtctcctctgtgaaggtatgctgggcagggtggcctgtccgggacatggtctacatggttgcagtgatgtgaggctggcgccagctgcagctccccacagtgtttacaccccgcactttgactaccgagccccacacgggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaagaacgaagctgtggcctctgtcttttgagcgcttatgaccacagcacgggctcagtccctcccagacccactcgctgtctggggataatgggcagcccctccttgcccactgtgccaacatgcaggtggcccctgagcagcttccatgggtggagacgctgctctgtcagtcacaggcttggaaaaagcgagtccccccactcttttttttttttttttttttttttttaccaacctgggcaccaagtcccagggggctgagggtctgtgcttcctgtctacctccctgccattctctcaccctcatcccacagcagggtctcaggagtcccactctccctctcctctcattccagtgccccacaactgcccagttaacccccagatgcaagccagattccatctgccccaggccccaagcttttgctttggcatcacgcgaggccaggctgctttgcaggcaccaaaattcaccctctcctactcctggaaaagcccagccccaggcctcacagagccaggggaggggatctcatcacatcacagttagaaatcatacaggcctaaagtcccagctacccaggagccaaggcaggaggaacccttgagcctgggagttggaggttacagtgagctatgatcacaccagctttctagcctgggtgacagagcaagacccaactcttaaaaaaaaaaaaaaaatacaggaaatgactaatgaacttgactccatgaaattgaaacttacgtggaaaattagtccaaagcctaaaagactagcaactgagaaaaaaaaacattgcaacacaaatgagagacaaagacctcacttatcttcattacagagagttcgtaatgtcaataagaaacagaaaaccggaaaggcaaacaggttaagggcatgggcagcaattgaattacaaagaaacagacagacccttaaacatcaatgcttgacctcacccaacagcagggaaacagtctccacaacagtaaaatgttgctgggatgggcccagcattcagcatggtccctgcaactttggcctctgcccagtgacctctggcgggtgtagaagagctcatgcttcagtgagggggtggggggcaccctgaggaccctgtcaacatcagctggaccacaggcatctcagatagatgtcacttaccaccctcatgttggcagagggtggtaaccagccagcatctccttcttaaacacctactaagtgtcaggcactgtgaccggagacacagtcaagaatctctgtgttttttttgttttgttttgtttttgttttttgagacggagtctcgctctgttgcccaggctggagtgcaatggcgcgatctcagctcactgccacctccgcctcccaggttcaagcaattctcctgcctcagcctcccgagtagctgcgattacaggcgtgcaccacaatgcctggataatttttgtattttcagtagaaacggggtttcaccatgttggccaggatggtcttgaactcctgagctcaggtgatccgcccgcctcatcctcccaaagtgctgggattacaggtgtgagctacctgcgctggccgaatctctgcttttaggagctcactcctcataggtagagttgacaataagcacacaaacaagtgagatagcagggcagccggaccacccagttgggcaattcgtggcttggcctaggaacgttacatttgactgaggctggcgaggcctgcagcctgcaccaggaggtacaatgtgagactgaggaatgggaagaaggcattccatggagctctgagggcactgggtgcaagggccttgcacatgcaaagaccctgttgtgggttcaagccactgtgtgggagggacaggagagcctggcgtggctgcggccttgaaggaggggactgtgcacacagaattgcaagtgggggtctccgcggaagctcctggcagttttaagcaggattattagatgattcagtcaactttacaactcactttgctgaatggagggtggattaacgagggggtagttggaggctaccccttggagggcattctggacttatctaccaaaatttcaaatgcacataccctctgacccagcagttccacttaagtatttggtcctgaaatcttggtaaaagtgcccaaagatacagaacaaggatgttcactatagcatctcttagaatatggccccaaacaggaagcaaccccaacctctatcatgagggaggtcataaaattcctgcacatgcaacagtgccatcctctgcagcctgtcaaagaggcaggcagcactaactgctggactggaatgttctccaagatataataaatgcatttgtttgaaagcagcttgcagcacagtgcgtcaggcctctgagcccaagccaagccatcgcatcccctgtgacttgcacgtatatgcctagatggcctgaagtaactgaagaatcacaaaagaagtgaatatgccctgccccgccttaactgatgacattccaccacaaaagaagtgaaaaaggccggtccttgacttaactgatgacattatcttatgaaattccttctcctggctcatcctggctcaaaaagctcccccactgagcacgttgccacccccactcctgcccgccagagaacaaaccccctttttcctttacctacccaaatcttataaaacggcctcacgcctatctcccttcactgactcccttttcggactcagcccacctgcgcccaggtgaaataaacagccttgttgctcacacaaagcctgtttggtggtctcttcacatggacgtgcattaaatttggtgccgtaactggcgcggggggaggggggggggaacctcccttgggagatcaatcccctgtcctcctgctctttggtccatgagaaagatccacctacaacctcaagtcctcagaccaaccagcccaagaaacatctcaccaatttcaaatccagtaagcagcctctttttactctcttctccaacctccctcactatccctcaacctctttctcctttcaatcttggcgccacacttcaatttctcccttctcttaacttcaattcctttcattttctggtagagataaaggagacacgttttatccgtggacccaaaactccagcgccggtcacggactgggaaggcagccttcccttggtgtttaatcattgcagggacacctctctgattattcacccaggtttcagaggtgtcagaccacgcagggacgcctgccttggtccttcacccttagcggcaagtcccgcttttctggggaatgggcaaggaccccaaccccttctctccgtgtctctaccccttctccgcctttctggggggcaagaaacccccaaccccttctccttcaccctgagcggcaagtcccgcttttctagaggaggagcaagtactccaacctcatatctctgcgccccaatcccttatttctgtgccccaacctcttatctctgtgccccaatcccttatttccatgcccccacctcttatatctctgcaccttgatcccttatttccacatcccgacctcgtatctctgcaccccgacccctttcccacttttctggagagtaagaacccctgaaccgcttctctccgtgtctctactctcccttttctttaaacttgcctccttcactgtaggcaaccttccactctccattcctccttcttctcccttagcctatgttctcaaaaacttaaaacctcttcaactcacacctgacctaaaacctaaatgccttattttcttctgcaatgccgcttgaccccaatacaaactcaacagtagttccaaatagccggaaaacagcactttcaatttttccatcctgcaagatctaaataattcttgtcgtaaaatgggcaaatggtctgaggtgcctgacgtccaggcgttcttttacacatcagtccctccctagtctctgttcccagtgcaactcatcccaaatcttccttctttccctcccgcctgtctcctcagtcccaaccccaagcatcgctgagtctttctaatcttttctatagacccatctgacctctcccctcctccccaggctgctccttgccaggccgagctaggtcccaattcttcctcagcctccgctcctccaccatataatctttttatcacctcccctcctcacacccggtccggcttacagtttccttccgtgactagccctcccctacctgcccagcaattttctcttaaaaaggtggctggagctaaaggcatagtcaaggttaatgctcctttttctttatcccaaatcagatagcgtttaggctctttttcatcaaatataaaaacccagcccagttcatgcctcgtttggcagcaaccctgagacactttacggccctagaccctaaaagcccaaaaggccgtcttattctcaatatatattttatcacccaatctgctccctacattaaataaaactccaaaaattaaattccggccctcaaaccccacaacaggatttaattaaccttgccttcaaggtgtacaataatagaaaaaagttgcaattccttgcctccactgtgagacaaaccccagccacatctccagcacacaagaacttccaaacacctgaactgcagcggccaggcattcctccagaacctcctcccccaggagcttgctacaagtgccagaaatctggccaccaggccaaggaatgcctgcagcccaggattcctcctaagccgtgtcccatctgtgcgggaccccactggaaatcggactgtccaactcacctggcagccactcccagagcccctggaactccggcccaaggctctctgactgactccttcccagatcttcttggcttagcggctgaagactgacactgcccgatcacctcggaagccccctagaccatcacggacgccgagctgccagtaactctcacagtggaaggtaaacccgtccccttcttaatcaatacggaggctacccactccacattaccttcttttcaagggcctgtttcccttacctccataactgttgtgcgtattgacagccaggcttctaaacctcttaaaactccccaactctggtgccaacttagacaatactcttttaagcactccttttagttatccccagctgcccagttcccttattaggctgagacactttaactaaattatctgcttccctgactattcctgggctacagccacacctcattactgcccttcttcccaatccaaagcctcctttgtgtcctcctcttgtatcccccgaccttaacccataagtataagatacctctactccctccttggtgaccgatcatgcaccccttaccatctcatcgaaacctaatcacccttaccccgctcaacaccaatatcccatcccacagcatgctttgaaaagactaaagcctgttatcactctcctgctacagcatggccttttaaagcctataaactctccttacaattcccccatttcacttgtcctaaaaccagacaagccttacaagttagttcaggatctgtgccttatcaaccacattgttttgcctatccaccccatggtgtcaaacccatatactctcctatcctcaatacctcactccataatccattattgtgttctggatctcaaacatgctttctttactattcctttgcacccttcatcccagcctctcttcactttcacttggactgaccctgacacccatcaggctcagcaaattacctgggctgtactgccccaaagcttcacagacagcccccattacatcagtcaagcccaaattttttccctatctgttacctatctcagcataattctcataaagacacacgtgctctccctgccgatcatgtccgattaatctcccaaaccccaaccccttctacaaaacaagaactcctttccttcctaggcatggttagtgcagtcagaattcttacacaagagccaggaccgcaccctgtagaccttctgtccaaacaacttgaccttactgttttagcctagccctcatgtctctgtgcagcggctgctgccaccctaatacttttagaggccctcaaaatcacaaactatgctcaactcactctctacagttatcataacttccaaaatctattttcttcctcatacctgacatatatactttctgctccccggctccttcagctgtactcactctttattgagtctcccacaattaccatttttcctggcaccgacttcaatccagcctcccacattattcctgataccacacctgacccccatgactgcatctctctgatccacctgacgttcaccccatttccccacatttccttcttccctgcttctcaccctgatcacacttggtttatggatggcagttccaccaggcctaatggccacacaccagcaaaggcaggctgtgctatagtacaagccgctagcccgcctcttagaacctctcatttcctttccatcgtggaaatctatcctcaaggaaataacttctcagtgttccatctgctattctactgctcctcagggattattcaggccccctcccttccctacacatcaagctcagggatttgcctccacccaggactggcaaattgactttactcaacatgccccgagtcagataactaaaatacctcttattctaggtagacactttcactggataggtagaggcctttcctacagggtctgagaaggccaccatggtcatttcttcccttctgtcaaacataattcctcggtttggccttcccacctctatactgtctgataacagaccagcctttattagtcaaatcagccaagcgttttttcaggctcttagtattcagtgaaacctttatatcccttacagtcctcagccttcaggaaaggtagaacggactaatgatcttttaaaaacacacctcaccaagctcagccaccaacttaaaaaagactggacaatacttttaccactttcccttctcagaattcaggcctgtccttggaatgctacaaggtacagcccatttgagctcctgtatagacgctcctttttattaggccccagtctcattccagacaccagaccaacttggactgtgccccaaaaaacttgtcatccctactatcttctgtctagtcgtactcctattcaccattctcaactactcatacgtgccctgctcttgtttacactgccagtttacactgtttctccaagccatcacagctgatatctcctggtgctatccccaaaccgccactctgaactcttaaatacataatctttgctggcaggactatgctgaacctcctttggcactctctaatcagatgtcctgagtcatctcaattcttagaccttttatacctgtttttctcctttacttattccgtttagtttttcaattcatacaaaaccgtatccaggtcatcaccaataattctaaatgacgaatgtttcttctaacaaccgcacaatatcaccccttaccacaagacctcccttcagcttaatctctcccactctaggttcccacgccgccccgaatcccgctcgaagcagccctgagaaacatcgcccattctctctctccacaccgccccccaaaaattttcgctgccccaacacttcgacactattttgttttatttttcttattaatataagaaggcaggaatgtcaggcctctgagcccaagctaagccatcgcatcccctgtgacctgcacgcatatataagcccagatggcctgaagtaactgaagaatcacaaaagaagtgaatatgccctgccccaccttaactgatgacattccaccacaaaagaagtgtaaatggctggttcttgccttaagtgatgacattaccttgtgaaagtccttttcctggctcatcctggctcaaaaagcacccccactgagcaccttgccgcccccactcctgcccgccagagaacaaaccccctttgactgtaattttcctttacctacccaaatcctataaaacggccccacccccatctccctgcactgactctcttttcggactcagcccgcctgcacccaggtgaaataaacagctttattgctcacac

SEQ ID NO: 148359 - DNA, 9158 bp, Homo sapiens
  Payload ID: 9376
  Gene Symbol: LRRK2
  Gene Name: leucine-rich repeat kinase 2
  Uniprot ID: Q5S007
  ENST ID: ENST00000298910
  CDS Start-End: 59-7642
ttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcctggaggatctgctggtgttcacgtactccgagcgcgcctccaagttatttcaaggcaaaaatatccatgtgcctctgttgatcgtcttggactcctatatgagagtcgcgagtgtgcagcaggtgggttggtcacttctgtgcaaattaatagaagtctgtccaggtacaatgcaaagcttaatgggaccccaggatgttggaaatgattgggaagtccttggtgttcaccaattgattcttaaaatgctaacagttcataatgccagtgtaaacttgtcagtgattggactgaagaccttagatctcctcctaacttcaggtaaaatcaccttgctgatattggatgaagaaagtgatattttcatgttaatttttgatgccatgcactcatttccagccaatgatgaagtccagaaacttggatgcaaagctttacatgtgctgtttgagagagtctcagaggagcaactgactgaatttgttgagaacaaagattatatgatattgttaagtgcgttaacaaattttaaagatgaagaggaaattgtgcttcatgtgctgcattgtttacattccctagcgattccttgcaataatgtggaagtcctcatgagtggcaatgtcaggtgttataatattgtggtggaagctatgaaagcattccctatgagtgaaagaattcaagaagtgagttgctgtttgctccataggcttacattaggtaattttttcaatatcctggtattaaacgaagtccatgagtttgtggtgaaagctgtgcagcagtacccagagaatgcagcattgcagatctcagcgctcagctgtttggccctcctcactgagactattttcttaaatcaagatttagaggaaaagaatgagaatcaagagaatgatgatgagggggaagaagataaattgttttggctggaagcctgttacaaagcattaacgtggcatagaaagaacaagcacgtgcaggaggccgcatgctgggcactaaataatctccttatgtaccaaaacagtttacatgagaagattggagatgaagatggccatttcccagctcatagggaagtgatgctctccatgctgatgcattcttcatcaaaggaagttttccaggcatctgcgaatgcattgtcaactctcttagaacaaaatgttaatttcagaaaaatactgttatcaaaaggaatacacctgaatgttttggagttaatgcagaagcatatacattctcctgaagtggctgaaagtggctgtaaaatgctaaatcatctttttgaaggaagcaacacttccctggatataatggcagcagtggtccccaaaatactaacagttatgaaacgtcatgagacatcattaccagtgcagctggaggcgcttcgagctattttacattttatagtgcctggcatgccagaagaatccagggaggatacagaatttcatcataagctaaatatggttaaaaaacagtgtttcaagaatgatattcacaaactggtcctagcagctttgaacaggttcattggaaatcctgggattcagaaatgtggattaaaagtaatttcttctattgtacattttcctgatgcattagagatgttatccctggaaggtgctatggattcagtgcttcacacactgcagatgtatccagatgaccaagaaattcagtgtctgggtttaagtcttataggatacttgattacaaagaagaatgtgttcataggaactggacatctgctggcaaaaattctggtttccagcttataccgatttaaggatgttgctgaaatacagactaaaggatttcagacaatcttagcaatcctcaaattgtcagcatctttttctaagctgctggtgcatcattcatttgacttagtaatattccatcaaatgtcttccaatatcatggaacaaaaggatcaacagtttctaaacctctgttgcaagtgttttgcaaaagtagctatggatgattacttaaaaaatgtgatgctagagagagcgtgtgatcagaataacagcatcatggttgaatgcttgcttctattgggagcagatgccaatcaagcaaaggagggatcttctttaatttgtcaggtatgtgagaaagagagcagtcccaaattggtggaactcttactgaatagtggatctcgtgaacaagatgtacgaaaagcgttgacgataagcattgggaaaggtgacagccagatcatcagcttgctcttaaggaggctggccctggatgtggccaacaatagcatttgccttggaggattttgtataggaaaagttgaaccttcttggcttggtcctttatttccagataagacttctaatttaaggaaacaaacaaatatagcatctacactagcaagaatggtgatcagatatcagatgaaaagtgctgtggaagaaggaacagcctcaggcagcgatggaaatttttctgaagatgtgctgtctaaatttgatgaatggacctttattcctgactcttctatggacagtgtgtttgctcaaagtgatgacctggatagtgaaggaagtgaaggctcatttcttgtgaaaaagaaatctaattcaattagtgtaggagaattttaccgagatgccgtattacagcgttgctcaccaaatttgcaaagacattccaattccttggggcccatttttgatcatgaagatttactgaagcgaaaaagaaaaatattatcttcagatgattcactcaggtcatcaaaacttcaatcccatatgaggcattcagacagcatttcttctctggcttctgagagagaatatattacatcactagacctttcagcaaatgaactaagagatattgatgccctaagccagaaatgctgtataagtgttcatttggagcatcttgaaaagctggagcttcaccagaatgcactcacgagctttccacaacagctatgtgaaactctgaagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaaggaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttgctgctatgcctttcttgcctccttctatgacaatcctaaaattatctcagaacaaattttcctgtattccagaagcaattttaaatcttccacacttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagagattcctcctgagattggctgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtcgtgaggaattctatagtactcatccccattttatgacgcagcgagcattgtaccttgctgtctatgacctcagcaagggacaggctgaagttgatgccatgaagccttggctcttcaatataaaggctcgcgcttcttcttcccctgtgattctcgttggcacacatttggatgtttctgatgagaagcaacgcaaagcctgcatgagtaaaatcaccaaggaactcctgaataagcgagggttccctgccatacgagattaccactttgtgaatgccaccgaggaatctgatgctttggcaaaacttcggaaaaccatcataaacgagagccttaatttcaagatccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggagtccttcttcattttcaagacccagcactgcagttaagtgacttgtactttgtggaacccaagtggctttgtaaaatcatggcacagattttgacagtgaaagtggaaggttgtccaaaacaccctaagggcattatttcgcgtagagatgtggaaaaatttctttcaaaaaaaaggaaatttccaaagaactacatgtcacagtattttaagctcctagaaaaattccagattgctttgccaataggagaagaatatttgctggttccaagcagtttgtctgaccacaggcctgtgatagagcttccccattgtgagaactctgaaattatcatccgactatatgaaatgccttattttccaatgggattttggtcaagattaatcaatcgattacttgagatttcaccttacatgctttcagggagagaacgagcacttcgcccaaacagaatgtattggcgacaaggcatttacttaaattggtctcctgaagcttattgtctggtaggatctgaagtcttagacaatcatccagagagtttcttaaaaattacagttccttcttgtagaaaaggctgtattcttttgggccaagttgtggaccacattgattctctcatggaagaatggtttcctgggttgctggagattgatatttgtggtgaaggagaaactctgttgaagaaatgggcattatatagttttaatgatggtgaagaacatcaaaaaatcttacttgatgacttgatgaagaaagcagaggaaggagatctcttagtaaatccagatcaaccaaggctcaccattccaatatctcagattgcccctgacttgattttggctgacctgcctagaaatattatgttgaataatgatgagttggaatttgaacaagctccagagtttctcctaggtgatggcagttttggatcagtttaccgagcagcctatgaaggagaagaagtggctgtgaagatttttaataaacatacatcactcaggctgttaagacaagagcttgtggtgctttgccacctccaccaccccagtttgatatctttgctggcagctgggattcgtccccggatgttggtgatggagttagcctccaagggttccttggatcgcctgcttcagcaggacaaagccagcctcactagaaccctacagcacaggattgcactccacgtagctgatggtttgagatacctccactcagccatgattatataccgagacctgaaaccccacaatgtgctgcttttcacactgtatcccaatgctgccatcattgcaaagattgctgactacggcattgctcagtactgctgtagaatggggataaaaacatcagagggcacaccagggtttcgtgcacctgaagttgccagaggaaatgtcatttataaccaacaggctgatgtttattcatttggtttactactctatgacattttgacaactggaggtagaatagtagagggtttgaagtttccaaatgagtttgatgaattagaaatacaaggaaaattacctgatccagttaaagaatatggttgtgccccatggcctatggttgagaaattaattaaacagtgtttgaaagaaaatcctcaagaaaggcctacttctgcccaggtctttgacattttgaattcagctgaattagtctgtctgacgagacgcattttattacctaaaaacgtaattgttgaatgcatggttgctacacatcacaacagcaggaatgcaagcatttggctgggctgtgggcacaccgacagaggacagctctcatttcttgacttaaatactgaaggatacacttctgaggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaagcaaacaaaaaaattttcttttggttggaaccgctgatggcaagttagcaatttttgaagataagactgttaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaagggaggtaatggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggaagccttaaaaatgtcatgctggtattgggctacaaccggaaaaatactgaaggtacacaaaagcagaaagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttaagacaggactattgcttgtcgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaacctttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactt

SEQ ID NO: 148360 - DNA, 4740 bp, Homo sapiens
  Payload ID: 9376
  Gene Symbol: LRRK2
  Gene Name: leucine-rich repeat kinase 2
  ENST ID: ENST00000343742
  CDS Start-End: 122-3937
gcgctggctgcgggcggtgagctgagctcgcccccggggagctgtggccggcgcccctgccggttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcctggaggatctgctggtgttcacgtactccgagcgcgcctccaagttatttcaaggcaaaaatatccatgtgcctctgttgatcgtcttggactcctatatgagagtcgcgagtgtgcagcaggtgggttggtcacttctgtgcaaattaatagaagtctgtccaggtacaatgcaaagcttaatgggaccccaggatgttggaaatgattgggaagtccttggtgttcaccaattgattcttaaaatgctaacagttcataatgccagtgtaaacttgtcagtgattggactgaagaccttagatctcctcctaacttcaggtaaaatcaccttgctgatattggatgaagaaagtgatattttcatgttaatttttgatgccatgcactcatttccagccaatgatgaagtccagaaacttggatgcaaagctttacatgtgctgtttgagagagtctcagaggagcaactgactgaatttgttgagaacaaagattatatgatattgttaagtgcgttaacaaattttaaagatgaagaggaaattgtgcttcatgtgctgcattgtttacattccctagcgattccttgcaataatgtggaagtcctcatgagtggcaatgtcaggtgttataatattgtggtggaagctatgaaagcattccctatgagtgaaagaattcaagaagtgagttgctgtttgctccataggcttacattaggtaattttttcaatatcctggtattaaacgaagtccatgagtttgtggtgaaagctgtgcagcagtacccagagaatgcagcattgcagatctcagcgctcagctgtttggccctcctcactgagactattttcttaaatcaagatttagaggaaaagaatgagaatcaagagaatgatgatgagggggaagaagataaattgttttggctggaagcctgttacaaagcattaacgtggcatagaaagaacaagcacgtgcaggaggccgcatgctgggcactaaataatctccttatgtaccaaaacagtttacatgagaagattggagatgaagatggccatttcccagctcatagggaagtgatgctctccatgctgatgcattcttcatcaaaggaagttttccaggcatctgcgaatgcattgtcaactctcttagaacaaaatgttaatttcagaaaaatactgttatcaaaaggaatacacctgaatgttttggagttaatgcagaagcatatacattctcctgaagtggctgaaagtggctgtaaaatgctaaatcatctttttgaaggaagcaacacttccctggatataatggcagcagtggtccccaaaatactaacagttatgaaacgtcatgagacatcattaccagtgcagctggaggcgcttcgagctattttacattttatagtgcctggcatgccagaagaatccagggaggatacagaatttcatcataagctaaatatggttaaaaaacagtgtttcaagaatgatattcacaaactggtcctagcagctttgaacaggttcattggaaatcctgggattcagaaatgtggattaaaagtaatttcttctattgtacattttcctgatgcattagagatgttatccctggaaggtgctatggattcagtgcttcacacactgcagatgtatccagatgaccaagaaattcagtgtctgggtttaagtcttataggatacttgattacaaagaagaatgtgttcataggaactggacatctgctggcaaaaattctggtttccagcttataccgatttaaggatgttgctgaaatacagactaaaggatttcagacaatcttagcaatcctcaaattgtcagcatctttttctaagctgctggtgcatcattcatttgacttagtaatattccatcaaatgtcttccaatatcatggaacaaaaggatcaacagtttctaaacctctgttgcaagtgttttgcaaaagtagctatggatgattacttaaaaaatgtgatgctagagagagcgtgtgatcagaataacagcatcatggttgaatgcttgcttctattgggagcagatgccaatcaagcaaaggagggatcttctttaatttgtcaggtatgtgagaaagagagcagtcccaaattggtggaactcttactgaatagtggatctcgtgaacaagatgtacgaaaagcgttgacgataagcattgggaaaggtgacagccagatcatcagcttgctcttaaggaggctggccctggatgtggccaacaatagcatttgccttggaggattttgtataggaaaagttgaaccttcttggcttggtcctttatttccagataagacttctaatttaaggaaacaaacaaatatagcatctacactagcaagaatggtgatcagatatcagatgaaaagtgctgtggaagaaggaacagcctcaggcagcgatggaaatttttctgaagatgtgctgtctaaatttgatgaatggacctttattcctgactcttctatggacagtgtgtttgctcaaagtgatgacctggatagtgaaggaagtgaaggctcatttcttgtgaaaaagaaatctaattcaattagtgtaggagaattttaccgagatgccgtattacagcgttgctcaccaaatttgcaaagacattccaattccttggggcccatttttgatcatgaagatttactgaagcgaaaaagaaaaatattatcttcagatgattcactcaggtcatcaaaacttcaatcccatatgaggcattcagacagcatttcttctctggcttctgagagagaatatattacatcactagacctttcagcaaatgaactaagagatattgatgccctaagccagaaatgctgtataagtgttcatttggagcatcttgaaaagctggagcttcaccagaatgcactcacgagctttccacaacagctatgtgaaactctgaagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaaggaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttgctgctatgcctttcttgcctccttctatgacaatcctaaaattatctcagaacaaattttcctgtattccagaagcaattttaaatcttccacacttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagaggtaagacgattattgccacttaaaaaatatactttatgatttgcatcattacaaattatcattttaagtgatatttagcttctaaataccaatttcatgaaactagaagcttcctgttaactataaattcctgtcaactataaatccagatttccattaaatttaaaaataagaacagctactaatgatgtgtcacttaatttaatttccattctcacaccgacaatttaaaaaaatctacttttaaaaataaggtagtagccttaatacttccactaaacaataaaacaatatgctatacttatcagaaccttttaatctgaaagctaaacagctagatataaatttgtctacccaacatttgtacaaagtaaaaattattagaatattcatttcaaattatgtgtgatgttatcatataacatattatagattaactcaaattattcttaactgttacttaactatgacaaaacaacttagaacgctttgctaatacacaagatagtataaggataaaaattctttatagtactagctcataaagagtgttctatggaatagtagtggatgtcatttaataactataaattcaaaataagcattgtaaatatcaataccattcaatttttttttgttttttaaacaagttgtaagcctaccctatggtaaatggatatggtaacacagcataatttcctcaaaaaattacttttgtgatatacttttaaaggattatatgaatatatacataattatagatgaatgtgatgctgtgtgtcattgtatcaccaaatctctgtccaatctgttaacagactcttaaataaaccatttttctc

SEQ ID NO: 148361 - DNA, 1655 bp, Homo sapiens
  Payload ID: 9376
  Gene Symbol: LRRK2
  Gene Name: leucine-rich repeat kinase 2
  ENST ID: ENST00000416796
  CDS Start-End: 93-1655
tggcagcgttttccccagaacatccccaagcctccaagttatttcaaggcaaaaatatccatgtgcctctgttgatcgtcttggactcctatatgagagtcgcgagtgtgcagcaggtgggttggtcacttctgtgcaaattaatagaagtctgtccaggtacaatgcaaagcttaatgggaccccaggatgttggaaatgattgggaagtccttggtgttcaccaattgattcttaaaatgctaacagttcataatgccagtgtaaacttgtcagtgattggactgaagaccttagatctcctcctaacttcaggtaaaatcaccttgctgatattggatgaagaaagtgatattttcatgttaatttttgatgccatgcactcatttccagccaatgatgaagtccagaaacttggatgcaaagctttacatgtgctgtttgagagaggcaataatgtggaagtcctcatgagtggcaatgtcaggtgttataatattgtggtggaagctatgaaagcattccctatgagtgaaagaattcaagaagtgagttgctgtttgctccataggcttacattaggtaattttttcaatatcctggtattaaacgaagtccatgagtttgtggtgaaagctgtgcagcagtacccagagaatgcagcattgcagatctcagcgctcagctgtttggccctcctcagaagttttccaggcatctgcgaatgcattgtcaactctcttagaacaaaatgcaacacttccctggatataatggcagcagtggtccccaaaatactaacagttatgaaacgtcatgagacatcattaccagtgcagctggaggcgcttcgagctattttacattttatagtgcctggcatgccagaagaatccagggaggatacagaatttcatcataagctaaatatggttaaaaaacagtgtttcaagaatgatattcacaaactggtcctagcagctttgaacaggttcattggaaatcctgggattcagaaatgtggattaaaagtaatttcttctattgtacattttcctgatgcattagagatgttatccctggaaggtgctatggattcagtgcttcacacactgcagatgtatccagatgaccaagaaattcagtgtctgggtttaagtcttataggatacttgattacaaagaagaatgtgttcataggaactggacatctgctggcaaaaattctggtttccagcttataccgatttaaggatgttgctgaaatacagactaaaggatttcagacaatcttagcaatcctcaaattgtcagcatctttttctaagctgctggtgcatcattcatttgacttagtaatattccatcaaatgtcttccaatatcatggaacaaaaggatcaacagtttctaaacctctgttgcaagtgttttgcaaaagtagctatggatgattacttaaaaaatgtgatgctagagagagcgtgtgatcagaataacagcatcatggttgaatgcttgcttctattgggagcagatgccaatcaagcaaaggagggatcttctttaatttgtcaggtatgtgagaaagagagcagtcccaaattggtggaactcttactgaatagtggatctcgtgaacaagatgtacgaaaa

SEQ ID NO: 148362 - DNA, 6400 bp, Homo sapiens
  Payload ID: 9376
  Gene Symbol: LRRK2
  Gene Name: leucine-rich repeat kinase 2
  ENST ID: ENST00000430804
  CDS Start-End: 1-623
cactagacctttcagcaaatgaactaagagatattgatgccctaagccagaaatgctgtataagtgttcatttggagcatcttgaaaagctggagcttcaccagaatgcactcacgagctttccacaacagctatgtgaaactctgaagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaaggaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttgtttcaggatgctctgtggtacctcaggggaatctgattcagactgtggagtcaggaaagcatttctgtgcctgtgacatttaagttgggtctggaaagaggagcatccaaaaggaccttgaagcttgtgtatggtcagtgtgtcatctcagctgaatctcacaatgatcctaatggtcatacctaggacaggtatgacctctgcccaattgaggaaattgaagccgtgagattttttgtgtgatgcttacagctgctatgcctttcttgcctccttctatgacaatcctaaaattatctcagaacaaattttcctgtattccagaagcaattttaaatcttccacacttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagagattcctcctgagattggctgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtcgtgaggaattctatagtactcatccccattttatgacgcagcgagcattgtaccttgctgtctatgacctcagcaagggacaggctgaagttgatgccatgaagccttggctcttcaatataaaggctcgcgcttcttcttcccctgtgattctcgttggcacacatttggatgtttctgatgagaagcaacgcaaagcctgcatgagtaaaatcaccaaggaactcctgaataagcgagggttccctgccatacgagattaccactttgtgaatgccaccgaggaatctgatgctttggcaaaacttcggaaaaccatcataaacgagagccttaatttcaagatccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggagtccttcttcattttcaagacccagcactgcagttaagtgacttgtactttgtggaacccaagtggctttgtaaaatcatggcacagattttgacagtgaaagtggaaggttgtccaaaacaccctaagggcattatttcgcgtagagatgtggaaaaatttctttcaaaaaaaaggaaatttccaaagaactacatgtcacagtattttaagctcctagaaaaattccagattgctttgccaataggagaagaatatttgctggttccaagcagtttgtctgaccacaggcctgtgatagagcttccccattgtgagaactctgaaattatcatccgactatatgaaatgccttattttccaatgggattttggtcaagattaatcaatcgattacttgagatttcaccttacatgctttcagggagagaacgagcacttcgcccaaacagaatgtattggcgacaaggcatttacttaaattggtctcctgaagcttattgtctggtaggatctgaagtcttagacaatcatccagagagtttcttaaaaattacagttccttcttgtagaaaaggctgtattcttttgggccaagttgtggaccacattgattctctcatggaagaatggtttcctgggttgctggagattgatatttgtggtgaaggagaaactctgttgaagaaatgggcattatatagttttaatgatggtgaagaacatcaaaaaatcttacttgatgacttgatgaagaaagcagaggaaggagatctcttagtaaatccagatcaaccaaggctcaccattccaatatctcagattgcccctgacttgattttggctgacctgcctagaaatattatgttgaataatgatgagttggaatttgaacaagctccagagtttctcctaggtgatggcagttttggatcagtttaccgagcagcctatgaaggagaagaagtggctgtgaagatttttaataaacatacatcactcaggctgttaagacaagagcttgtggtgctttgccacctccaccaccccagtttgatatctttgctggcagctgggattcgtccccggatgttggtgatggagttagcctccaagggttccttggatcgcctgcttcagcaggacaaagccagcctcactagaaccctacagcacaggattgcactccacgtagctgatggtttgagatacctccactcagccatgattatataccgagacctgaaaccccacaatgtgctgcttttcacactgtatcccaatgctgccatcattgcaaagattgctgactacggcattgctcagtactgctgtagaatggggataaaaacatcagagggcacaccagggtttcgtgcacctgaagttgccagaggaaatgtcatttataaccaacaggctgatgtttattcatttggtttactactctatgacattttgacaactggaggtagaatagtagagggtttgaagtttccaaatgagtttgatgaattagaaatacaaggaaaattacctgatccagttaaagaatatggttgtgccccatggcctatggttgagaaattaattaaacagtgtttgaaagaaaatcctcaagaaaggcctacttctgcccaggtctttgacattttgaattcagctgaattagtctgtctgacgagacgcattttattacctaaaaacgtaattgttgaatgcatggttgctacacatcacaacagcaggaatgcaagcatttggctgggctgtgggcacaccgacagaggacagctctcatttcttgacttaaatactgaaggatacacttctgaggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaagcaaacaaaaaaattttcttttggttggaaccgctgatggcaagttagcaatttttgaagataagactgttaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaagggaggtaatggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggaagccttaaaaatgtcatgctggtattgggctacaaccggaaaaatactgaaggtacacaaaagcagaaagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttaagacaggactattgcttgtcgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaacctttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactttaaa

SEQ ID NO: 148363 - DNA, 6428 bp, Homo sapiens
  Payload ID: 9377
  Gene Symbol: LGI2
  Gene Name: leucine-rich repeat LGI family, member 2
  Uniprot ID: Q8N0V4
  ENST ID: ENST00000382114
  CDS Start-End: 187-1824
gagtgggggtggcggccagcatgctgctcggctgcggctcggcctcccacacccgcggctccctagtcctcgccagcagcggcggcggcagagcagcgagcggcgcccgcgtctgcagcggcgccgggtccgagcgcgcggcgcggcggtgggggtcggggcccgggcggggagcggggaccgggcatggcgctgcggagaggcggctgcggagcgctcgggctgctgctgctgctgctgggcgccgcgtgcctgataccgcggagcgcgcaggtgaggcggctggcgcgctgccccgccacttgcagctgtaccaaggagtctatcatctgcgtgggctcttcctgggtgcccaggatcgtgccgggcgacatcagctccctgagcctggtaaatgggacgttttcagaaatcaaggaccgaatgttttcccatctgccttctctgcagctgctattgctgaattctaactcattcacgatcatccgggatgatgcttttgctggactttttcatcttgaatacctgttcattgaagggaacaaaatagaaaccatttcaagaaatgcctttcgtggcctccgtgacctgactcacctttctttggccaataaccacataaaagcactaccaagggatgtcttcagtgatttagactctctgattgaactagatttgaggggtaataaatttgaatgtgactgcaaagccaagtggctatacctgtggttgaagatgacaaattccaccgtttctgatgtgctgtgtattggtccaccagagtatcaggaaaagaagctaaatgacgtgaccagctttgactatgaatgcacaactacagattttgttgttcatcagactttaccctaccagtcggtttcagtggatacgttcaactccaagaacgatgtgtacgtggccatcgcgcagcccagcatggagaactgcatggtgctggagtgggaccacattgaaatgaatttccggagctatgacaacattacaggtcagtccatcgtgggctgtaaggccattctcatcgatgatcaggtctttgtggtggtagcccagctcttcggtggctctcacatttacaaatacgacgagagttggaccaaatttgtcaaattccaagacatagaggtctctcgcatttccaagcccaatgacatcgagctgtttcagatcgacgacgagacgttctttgtcatcgcagacagctcaaaggctggtctgtccacagtttataaatggaacagcaaaggattctattcttaccagtcactgcacgagtggttcagggacacggatgcggagtttgttgatatcgatggaaaatcgcatctcatcctgtccagccgctcccaggtccccatcatcctccagtggaataaaagctctaagaagtttgtcccccatggtgacatccccaacatggaggacgtactggctgtgaagagcttccgaatgcaaaataccctctacctttcccttacccgcttcatcggggactcccgggtcatgaggtggaacagtaagcagtttgtggagatccaagctcttccatcccggggggccatgaccctgcagcccttttcttttaaagataatcactacctggccctggggagtgactatacattctctcagatataccagtgggataaagagaagcagctattcaaaaagtttaaggagatttacgtgcaggcgcctcgttcattcacagctgtctccaccgacaggagagatttcttttttgcatccagtttcaaagggaaaacaaagatttttgaacatataattgttgacttaagtttgtgaaggtgtggtgggtgaaactaagagaaatgtagcattagctctcacaaaagaggaccaagaaaaatcaacaaacaaatcaaagccaggctcagagctctgaaattaaaaagcactgaaatagttagatgttttcaaacttttagaactcacattttaatcagggattgcatttattggctaactgcatgacatgcccattctaccatttaaaaaaaaatcttaaagcctgtaatttctgagaaaagagtacagcatttactcttatcatctagaaatgtaatatgcttcccccccgctttttgatgaggaagaagacaattggataagatgggacagcacttataatgaaataaaaaaaaactttgagcccctctcattccactttagcaatctttttggtaagaactcttaaagccaaaagtctgctgaaaagatttgctgattattagtttaaaaatcttgtaacactcagcagtgctattttgagtcatcccagtttcctgaaagtaatgcccagtcttcctgaatcctccttaatagcagaaccttggtgattttgttggctcatatgaatgcttgtcatggatatgttaacaatttagtgtttgacattgcttcctctgccacaaagacaatactctggtgacacatgtctagacccagcacaggctgtaggcccaggagtgactcaaaggagtttttccctctttcttacggttcaaaggtgaccctggtggtggccagagcagtaatgcttgtttgatgctcttcatggctcatctgcttctcagaacccacccgttgagtttgtgggtaaccagcaggcaggccaaagactggtgcttttcatttcatcctttagagggatgaaacagttatttccgtctgatgagcattcggtagaatttttgaagtgagattttatgaagtcaaaggggactttacacagatctcgacctgctttgaaacctagaggtggccctttgatttgtgcgtgtccttgccctctggacaacttaatatttcaagtaatcgaataccaacttccctgccagcccacctgccttccgccccgcttgtgtaacagtcctgttttgttgagttgctgctattgcactgccagtgcagcccacaccaaatcacaacccaagatactcagataggaagactccttcctctcccagtactttaccaaaggaacccccgccaggacccacatggggccacgtgttggcagtggaatcagcctgtgcaggctggggatctcaggctgatcagtaggggccagctttggagccagccaagctgaatcccacactccaggtctgtgctcaagagaccagatggtgtatttccaaatgggcctctctggtatgggcaataggcaagctcctggggtctggttatgtggaagattcttagtggatgttccgcctggttagctggttctcttcagagaatataaagtgaatgcctttaggggtagctctgaaagagaaacccaacaacttcattcctagccatgaaagtagcacgatcatattgtactgtattgttattgtaaaatgactatttgccatgtcatgagtaggtagatgttttgccacaaatatgaatgtgtttgttgtttcctgactttaagcaatgaagattgagacaataaatagcactcagagaatgaagcattgatgttacatcagcactcttgggtacattctgggactgtaggctgaggcttctagcctcagaaaccacggattttaatgaacgaactcacccacgcatagtagtgttgttacttgaaacttctgcaaaataccaagcaaacaggagaaaagtggtttgttttcatttttaagtgcaaattacttttcttctgcacttttttttccctcttggtttctttgaacaggctacaaatgcccaggtccccccattggaggctgaaagggaaagagctttgccattcctccagtcctaaagatggcaagctattctttctgttgcatggaaccactcagataaacctgggcagaaaaatgggtacttggcaaactgtaggagatatttagacagtcccagcaactatgccagatcaaagtgatgttcccaattccagccacctgtagagatggcaaggtggcatcttttcacagtgttgctactgcagagaggtatcacattcccagctgcccctctgagggtaaatgagcgactgaccccctgcactcactattctgctcacattgccagattctgggaaaccaggaaacacaggatgctgggcttaggatggggagagctgttgagtccagatggggaattaggaggtgaaagaacgatctaaacaggtgatgggtggggtgtgagaagggggtgacccactcaactgcaatcaggttttccttttttataatgttattttatacaagactaaagcctgtagtctacagagcgcctgtgctgtggaaggagatatttgttctggccaacttactaaaggagcatagatgttcttggcacggggtggtgatatctttgcttcattaatcttactgctccatcccaagaatccctgaagttttaaacaacttctgcaagaagcattcttccagtaataatgtaaaacaaaaaaccaaccaagcaacagcaaaaatgcaaagcagagaaatatgtggaccgtccccagtggagatcagcttgaaggagggggtggatctttcttctactttccctcccatcacccactgggtggtcgtctgctcagcttatttcttctttatgaactttgtggcgaggctcctggactgatccctctgtgcggccatgtggctttaaggcctttccttaaagggggcttgtccccatactccatggggtcgggaatgggtctattatcaagactctaaaaataactcttagacatgaagagcactgtgttattggacagtggatgataaggccaccttacatttagcaaagctttatatttttccaatgcacattagtactcacctcatttgttcataaatagctctgaagtttattgcagggcaggtattattctaatttcagagagaaggaaatagacatgaaaactatatgaattgcctgccatggttatccaatagggactggcaaagcaataactttccctctgatcagcagacattgtattttctttctaagacaccctgctatactctcccagagaaagactttcatttctagcatgattttgaatttggcagcaccttgagataaagtaaaaagtgcaataaaatatgcatagccagaagaaaaatcatactgaatagacaccattcaatcaactggtccatttaacaattaacaaacatgcaattgcatgccccactctttttacattcaaggccccactcttgaaagtggtccagaaattttggatagttttctgttgtactaaggaggatatctagctggtctggttgtttctccccctgcatagctatggggaggatgttgaggttgagacacatctggttcttgtcacattgtccaccagataaacaagaagagatctgtgaaggaaaaattcaaaacctgaatgcacgagtggtgatgaattgctctcggccgtcatcagccttcaggaagcacactggaaatggcagagttgcattttttcttccccatggagtgagagtctgtgtatttttaggaaagaaatcagcatgggatgccagaggtttggcggtcaggagtgctcatgatggaaatttctctggcctggggtataatgaaggtgagatgaagatctgcaggaggggagtctatttgcatgccacctaaagaaaacctcttaagctggcttcctgattcttctgcagaggtatcagcctctccttcgcagctgcggaaggaagttctttaattaggcagcggccaaagattctgttcaacagcttcctggagtggaatacaataatctagttgtatgcaatgatgcaattagaaagtggtccggatttgggtggcaatggaaggggaatggcaaagtggggcagatggctctggaggaaacttgggaaagtaaaaacaaactgaaagaaaaggaaaaaaggatgatgatttcttttgcctcagccaggcaagcagagggtagaatgaccaggaagattaacaacatctcaattattaatgaagagagccaactgtaatgctcattcaaataagaagcatattgtaaagctactgagatcgaaaccaagttattattatccttactgtattccattgcttgtatcaaaatctactttttttctagtaggaaactatgcattccctatcagtccctttgattatcaggaatgtataagaattgtgataaaataggccaatatgctatttggtaccatttgtatgtattttaagtgcataacctaggtaaaataagaatagtttctatgtgtaaagaagcaagttttacagtatgcagactacagtggatgtattttaggctgtatacatatttagctctttttggtaaatagggtatacaaactatatgcctcttaattcaatatattcggtaagcctatgaataaaaagtggttcatgcctaa

SEQ ID NO: 148364 - DNA, 767 bp, Homo sapiens
  Payload ID: 9377
  Gene Symbol: LGI2
  Gene Name: leucine-rich repeat LGI family, member 2
  ENST ID: ENST00000512108
  CDS Start-End: 1-767
cgctcgggctgctgctgctgctgctgggcgccgcgtgcctgataccgcggagcgcgcaggtgaggcggctggcgcgctgccccgccacttgcagctgtaccaaggagtctatcatctgcgtgggctcttcctgggtgcccaggatcgtgccgggcgacatcagctccctgagcctggtaaatgggacgttttcagaaatcaaggaccgaatgttttcccatctgccttctctgcagctgctattgctgaattctaactcattcacgatcatccgggatgatgcttttgctggactttttcatcttgaatacctgttcattgaagggaacaaaatagaaaccatttcaagaaatgcctttcgtggcctccgtgacctgactcacctttctttggccaataaccacataaaagcactaccaagggatgtcttcagtgatttagactctctgattgaactagatttgaggggtaataaatttgaatgtgactgcaaagccaagtggctatacctgtggttgaagatgacaaattccaccgtttctgatgtgctgtgtattggtccaccagagtatcaggaaaagaagctaaatgacgtgaccagctttgactatgaatgcacaactacagataaacaagaagagatctgtgaaggaaaaattcaaaacctgaatgcacgagtggtgatgaattgctctcggccgtcatcagccttcaggaagcacactggaaatggcagagttgcattttttcttccccatggagtgaga

SEQ ID NO: 148365 - DNA, 3272 bp, Homo sapiens
  Payload ID: 9378
  Gene Symbol: LGI3
  Gene Name: leucine-rich repeat LGI family, member 3
  Uniprot ID: Q8N145
  ENST ID: ENST00000306317
  CDS Start-End: 291-1937
gcgcgcgcccccgccgcccgcgccgcagtccgcagccacccggcgcggtcagccccggctgcggctccagctccgcgctccgctcttctctcccgagccggatcgcgggagcgagcaggggaggggaccgcagccggcgcccgagggcaggaggagtccgcaggcgggcccctggctgcggtagcagctgccggtggcagggaggtgccagcccgcgcggggtggcccagccgcgggagcggtggggcgggggccgcggccgccggccccagggagagatcgcgggcagcatggcggggctgcgggccagggggggcccggggccggggctgctggcgctctccgcgctcggcttctgcctcatgctgcaagtcagcgctaagaggccccccaagacgcccccctgcccgcccagctgctcttgcaccagggacaccgccttctgcgtggactcaaaggcggtgcccaggaacctgccctcggaggtcatctccctgaccctggtgaatgccgccttctcagagatccaggatggagcgttctcccacctcccgctgctgcagttcttgttactcaactccaacaagtttacactgattggagacaacgccttcacaggactgtcgcacctgcagtatctcttcattgagaacaatgacatctgggcactatccaagttcaccttccgaggactcaagtccttgactcacctctcgctggccaacaataacctgcagacactgcccagagacatcttccggcccctggacatcctgaatgacttggacctgcggggcaactcactcaactgtgactgcaaggtgaagtggttggtggagtggctggcacacaccaacaccacggtggcacccatctactgcgccagcccgccccgcttccaggagcacaaggtgcaggacctgccgctgcgggagttcgattgcatcaccacagattttgtgttgtaccagaccctggccttcccagcagtgtcggctgagcccttcctctactccagtgacctctatttggctctggcccagccaggagtcagtgcctgcaccatcctgaagtgggactatgttgagcggcagcttcgagactatgatagaatcccagccccctctgcagtgcactgcaagccgatggtggtggacagccagctgtacgtggtcgtggcccagctgtttggcggctcttacatttaccactgggatcccaacaccacgcgcttcaccaggctgcaagacattgacccgcagcgcgtgcgcaagcctaacgacctagaagccttccgcatcgacggtgactggtactttgccgtggctgacagctccaaggcaggcgccaccagcctctaccgctggcaccagaatggcttctactcccaccaggcactgcacccctggcaccgtgacaccgacctggagtttgtggacggcgagggcaagccacggctgattgtgtccagcagctcccaggcacccgtcatctatcagtggagtcgcacccagaagcagtttgtggcccagggtgaggtgacccaggtgcctgatgcccaagctgtgaaacactttcgtgccggccgcgacagctacctgtgcctcagccgctacattggcgactccaagatcctgcgctgggagggtacccgcttctcggaggtgcaggccctgccctcccggggctcgctggccctgcagcccttccttgtgggtggccgccgctacctggcactgggcagtgatttctccttcacccagatctaccagtgggatgagggacgacagaagtttgtacggttccaggagctggctgtgcaggctcctcgggccttctgctacatgcctgctggggacgcccagctactcctggcccccagcttcaagggacagacgctggtgtatagacacattgtggtggatctcagtgcctagggggtgccgaggcctctggtctcctcagggtggccactggaggatgggtgggggcctctgtgagcaccacgtatgcctgtgtgaagacaagcgaccaacctgcattcatgcccttgtatccgcacacgcccagtgtgtacaggcgcaccccgtggactggcccaggaggacgtgcatcatcactgcaatcagcatgaacaccaggcacccctgggacacctaacgcccagttcccgtgaccccaactgcaggccccccctactctgcagcctttcccatgctctgccccctgtctcatgcacgagtggtgcggggtgctgggagcgaggggggccgcatcctcctgtccttgtgcttctccttctgcccctctggtctttcctgttggtgctccaggcattgtttacctgctcttgctccccgctgtagcccacagccatatctgtcatgcttccccggggccactcacccctgccccaccccgtctgcatgctcacatggacgcggacggacacactcattacacactcacacgccccgactgcacccggtgtccatctataaacatgtcagggcacgtgtgcatacaagcagattcagcactgcctaccaggctctcctgttaccttgcctctctgcttggagggggccccctctgctcacccccagcgtgccccccccggaactgataaggatgagaatggtggtgccagcttctgagggcctgcttggcctcctgggggcaaagcccctctgcccgaagcaataacaacagcagcagaagcaatcccggggagctgccaggggtgtctgtctctgttctccttggcgtttccttcatggccgtgaatcccagctcacccatggacagaagacctcccctcatctgaaagcctttctgccttccttcctgtagctgtcgctttctcaggcttggactgtcccctggttcaccctgtctttgggatgtggcccttgagctgggcgggctccttgggtggattagagagctggccgagctgcaagcacctgagttacctgcgagggtgcccagagtggagcttggcctgagggcgtgttgcagccctggccccaccagtccacagaggcccccaggagcactgcctttcagtggaccgggtggggcctggtgggaggggccccactagctgagcttctgctgccctctgctgtctgctgagatgccaggctagtggagagggcacaccatgtgcccaaatggtgtgatgctccttgtagcaggataccagggtactggggggcaatgctatgattaacttgcttcaaataaaaagttcccgccccataaccggc

SEQ ID NO: 148366 - DNA, 3114 bp, Homo sapiens
  Payload ID: 9378
  Gene Symbol: LGI3
  Gene Name: leucine-rich repeat LGI family, member 3
  Uniprot ID: Q8N145
  ENST ID: ENST00000424267
  CDS Start-End: 210-1784
gctcttctctcccgagccggatcgcgggagcgagcaggggaggggaccgcagccggcgcccgagggcaggaggagtccgcaggcgggcccctggctgcggtagcagctgccggtggcagggaggtgccagcccgcgcggggtggcccagccgcgggagcggtggggcgggggccgcggccgccggccccagggagagatcgcgggcagcatggcggggctgcgggccagggggggcccggggccggggctgctggcgctctccgcgctcggcttctgcctcatgctgcaagtcagcgctaagaggccccccaagacgcccccctgcccgcccagctgctcttgcaccagggacaccgccttctgcgtggactcaaaggcggtgcccaggaacctgccctcggaggtcatctccctgaccctggtgaatgccgccttctcagagatccaggatggagcgttctcccacctcccgctgctgcagttcttgttactcaactccaacaagtttacactgattggagacaacgccttcacaggactgtcgcacctgcagtatctctcgctggccaacaataacctgcagacactgcccagagacatcttccggcccctggacatcctgaatgacttggacctgcggggcaactcactcaactgtgactgcaaggtgaagtggttggtggagtggctggcacacaccaacaccacggtggcacccatctactgcgccagcccgccccgcttccaggagcacaaggtgcaggacctgccgctgcgggagttcgattgcatcaccacagattttgtgttgtaccagaccctggccttcccagcagtgtcggctgagcccttcctctactccagtgacctctatttggctctggcccagccaggagtcagtgcctgcaccatcctgaagtgggactatgttgagcggcagcttcgagactatgatagaatcccagccccctctgcagtgcactgcaagccgatggtggtggacagccagctgtacgtggtcgtggcccagctgtttggcggctcttacatttaccactgggatcccaacaccacgcgcttcaccaggctgcaagacattgacccgcagcgcgtgcgcaagcctaacgacctagaagccttccgcatcgacggtgactggtactttgccgtggctgacagctccaaggcaggcgccaccagcctctaccgctggcaccagaatggcttctactcccaccaggcactgcacccctggcaccgtgacaccgacctggagtttgtggacggcgagggcaagccacggctgattgtgtccagcagctcccaggcacccgtcatctatcagtggagtcgcacccagaagcagtttgtggcccagggtgaggtgacccaggtgcctgatgcccaagctgtgaaacactttcgtgccggccgcgacagctacctgtgcctcagccgctacattggcgactccaagatcctgcgctgggagggtacccgcttctcggaggtgcaggccctgccctcccggggctcgctggccctgcagcccttccttgtgggtggccgccgctacctggcactgggcagtgatttctccttcacccagatctaccagtgggatgagggacgacagaagtttgtacggttccaggagctggctgtgcaggctcctcgggccttctgctacatgcctgctggggacgcccagctactcctggcccccagcttcaagggacagacgctggtgtatagacacattgtggtggatctcagtgcctagggggtgccgaggcctctggtctcctcagggtggccactggaggatgggtgggggcctctgtgagcaccacgtatgcctgtgtgaagacaagcgaccaacctgcattcatgcccttgtatccgcacacgcccagtgtgtacaggcgcaccccgtggactggcccaggaggacgtgcatcatcactgcaatcagcatgaacaccaggcacccctgggacacctaacgcccagttcccgtgaccccaactgcaggccccccctactctgcagcctttcccatgctctgccccctgtctcatgcacgagtggtgcggggtgctgggagcgaggggggccgcatcctcctgtccttgtgcttctccttctgcccctctggtctttcctgttggtgctccaggcattgtttacctgctcttgctccccgctgtagcccacagccatatctgtcatgcttccccggggccactcacccctgccccaccccgtctgcatgctcacatggacgcggacggacacactcattacacactcacacgccccgactgcacccggtgtccatctataaacatgtcagggcacgtgtgcatacaagcagattcagcactgcctaccaggctctcctgttaccttgcctctctgcttggagggggccccctctgctcacccccagcgtgccccccccggaactgataaggatgagaatggtggtgccagcttctgagggcctgcttggcctcctgggggcaaagcccctctgcccgaagcaataacaacagcagcagaagcaatcccggggagctgccaggggtgtctgtctctgttctccttggcgtttccttcatggccgtgaatcccagctcacccatggacagaagacctcccctcatctgaaagcctttctgccttccttcctgtagctgtcgctttctcaggcttggactgtcccctggttcaccctgtctttgggatgtggcccttgagctgggcgggctccttgggtggattagagagctggccgagctgcaagcacctgagttacctgcgagggtgcccagagtggagcttggcctgagggcgtgttgcagccctggccccaccagtccacagaggcccccaggagcactgcctttcagtggaccgggtggggcctggtgggaggggccccactagctgagcttctgctgccctctgctgtctgctgagatgccaggctagtggagagggcacaccatgtgcccaaatggtgtgatgctccttgtagcaggataccagggtactggggggcaatgctatgattaacttgcttcaaataaaaagttcccgccccataa

SEQ ID NO: 148367 - DNA, 663 bp, Homo sapiens
  Payload ID: 9378
  Gene Symbol: LGI3
  Gene Name: leucine-rich repeat LGI family, member 3
  ENST ID: ENST00000517694
  CDS Start-End: 70-663
aaagaaacccaggtagacagaagcacagggatccctaacgccgaagcgcctccacaaggcagtgagtgcatgtgcccgtgcagagacaggaccctggtgaatgccgccttctcagagatccaggatggagcgttctcccacctcccgctgctgcagttcttgttactcaactccaacaagtttacactgattggagacaacgccttcacaggactgtcgcacctgcagtatctcttcattgagaacaatgacatctgggcactatccaagttcaccttccgaggactcaagtccttgactcacctctcgctggccaacaataacctgcagacactgcccagagacatcttccggcccctggacatcctgaatgacttggacctgcggggcaactcactcaactgtgactgcaaggtgaagtggttggtggagtggctggcacacaccaacaccacggtggcacccatctactgcgccagcccgccccgcttccaggagcacaaggtgcaggacctgccgctgcgggagttcgattgcatcaccacagattttgtgttgtaccagaccctggccttcccagcagtgtcggctgagcccttcctctactccagtgacctctatttggctctggcccagccaggagtcagtgcctgcaccatcctg

SEQ ID NO: 148368 - DNA, 784 bp, Homo sapiens
  Payload ID: 9378
  Gene Symbol: LGI3
  Gene Name: leucine-rich repeat LGI family, member 3
  ENST ID: ENST00000518365
  CDS Start-End: 136-540
gtccgcaggcgggcccctggctgcggtagcagctgccggtggcagggaggtgccagcccgcgcggggtggcccagccgcgggagcggtggggcgggggccgcggccgccggccccagggagagatcgcgggcagcatggcggggctgcgggccagggggggcccggggccggggctgctggcgctctccgcgctcggcttctgcctcatgctgcaagtcagcgctaagaggccccccaagacgcccccctgcccgcccagctgctcttgcaccagggacaccgccttctgcgtggactcaaaggcggtgcccaggaacctgccctcggaggtcatctccctcacagcccttgcagaccccacagtactgactcgggtgtccccgcaggaccctggtgaatgccgccttctcagagatccaggatggagcgttctcccacctcccgctgctgcagttcttgttactcaactccaacaagtttacactgattggagacaacgccttcacaggactgtcgcacctgcagtatctcttcattgagaacaatgacatctgggcactatccaagttcaccttccgaggactcaagtccttgactcacctctcgctggccaacaataacctgcagacactgcccagagacatcttccggcccctggacatcctgaatgacttggacctgcggggcaactcactcaactgtgactgcaaggtgaagtggttggtggagtggctggcacacaccaacaccacggtggcacccatctactgcgccagcccgccc

SEQ ID NO: 148369 - DNA, 2814 bp, Homo sapiens
  Payload ID: 9379
  Gene Symbol: LGI4
  Gene Name: leucine-rich repeat LGI family, member 4
  Uniprot ID: Q8N135
  ENST ID: ENST00000310123
  CDS Start-End: 521-2134
gccgggtgtccagcgaacccctttcccaaaccttcggggagaagggaggtgggaggaggcaaagaaactacaggcagggagctggaagggggggtggggggggcaggagacaagaaatcaagacaccaggcagcaggacacacacacactcacatacactcacacacatagagaccaacagatagacagctacctaaagcctgaaagactgacagcaacacagaaaaaaagaaacaggcagaaagagagacaaagacagaaatagaaacagactaacacacagagtcaaaaatacagagacagaaagacagggagaaagagaaacagaaaattagacaccaaagacatacgaacagggaggaaggccgactgaaagaaagacggagaagaggagagagaagccagggccgagcgtgccagcaggcggatggagggcggcctggtggaggaggagacgtagtggcctgggctgagctgggtgggccgggagaagcgggtgcctcagagtgggggtgggggcatgggaggggcaggcattctgctgctgctgctggctggggcgggggtggtggtggcctggagacccccaaagggaaagtgtcccctgcgctgctcctgctctaaagacagcgccctgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcatgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccatagagctgtcctggttccagacggtgggggagtcggcactgagcgtagagcccttctcctaccaaggggagcctcacattgtgctggcacagcccttcgccggccgctgcctgattctctcctgggactacagcctgcagcgcttccggcccgaggaagagctgcccgcggcctccgtggtgtcctgcaagccactggtgctgggcccgagcctcttcgtgctggctgcccgcctgtgggggggctcacagctgtgggcccggcccagtcccggcctgcgcctggccccaacgcagaccctggccccgcggcggctgctgcggcccaatgacgccgagctcctgtggctggaagggcaaccctgcttcgtggtggccgatgcctccaaggcgggcagcaccacgctgctgtgccgcgacgggcccggcttttacccgcaccagagcctgcacgcctggcaccgggacacggacgctgaggccctggagctggacggccggccccacctgctgctggcctcggcttcccagcggcccgtgctcttccactggaccggtggccgcttcgagagacgcacagacatccccgaggccgaggatgtctatgccacacgccacttccaggctggtggggacgtgttcctgtgcctcacacgctacattggggactccatggtcatgcgctgggacggctccatgtttcgtctgctgcagcaacttccctcgcgcggtgcccacgtcttccagccactgctcatcgccagggaccagctggccatcctaggcagcgacttcgccttcagccaggtcctccgccttgagcctgacaaggggctcctggagccactgcaggagctggggcctccggccctggtggccccccgtgcctttgcccacatcactatggccggcagacgcttcctctttgctgcttgctttaagggccccacacagatctaccagcatcacgagatcgacctcagtgcctgagaccaccaacgggactctgggcatggctggggcccctggacggccccttggctggctcctggccctacttggggtgatggcccgcctgtgagctgctgaccgtgggccacgttcatcagccacacgtctaggccttaagcccacttcttaaaggatctgcacccatggggggacatagagggtcccagcctactggacctcccgagctgcccttcaggtctaaagcaacatctggacatctcggctggggcagattccccatcaaaggcaacctggggggtgcaggctggtgcactgcatggagtcgaggtggaggtcacgtgcagagctccatgaggtcccggagcccccctctcaacccgctcctaccccgctggtccctctgaaagcaccgaggggttgatggcattcctttcccattctaaactccacgcagccaatcgctttcctggaggagcgccaacctcgaagacaactcagcactgggcgggttcccctctgctgcttgtgcgcatgcgtgcggccgcccagcaagctgtgccttttgcgcctcttgcgcgtgcgccggggcacagggagggacagcgggaggtgtcgcggggagcctggtgcccttctagatgggcgacggaggcaaggacaagacgagtccgagctcaataaatgcgctgtgcaccctc

SEQ ID NO: 148370 - DNA, 2891 bp, Homo sapiens
  Payload ID: 9379
  Gene Symbol: LGI4
  Gene Name: leucine-rich repeat LGI family, member 4
  ENST ID: ENST00000392225
  CDS Start-End: 521-2005
gccgggtgtccagcgaacccctttcccaaaccttcggggagaagggaggtgggaggaggcaaagaaactacaggcagggagctggaagggggggtggggggggcaggagacaagaaatcaagacaccaggcagcaggacacacacacactcacatacactcacacacatagagaccaacagatagacagctacctaaagcctgaaagactgacagcaacacagaaaaaaagaaacaggcagaaagagagacaaagacagaaatagaaacagactaacacacagagtcaaaaatacagagacagaaagacagggagaaagagaaacagaaaattagacaccaaagacatacgaacagggaggaaggccgactgaaagaaagacggagaagaggagagagaagccagggccgagcgtgccagcaggcggatggagggcggcctggtggaggaggagacgtagtggcctgggctgagctgggtgggccgggagaagcgggtgcctcagagtgggggtgggggcatgggaggggcaggcattctgctgctgctgctggctggggcgggggtggtggtggcctggagacccccaaagggaaagtgtcccctgcgctgctcctgctctaaagacagcgccctgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcatgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccatagagctgtcctggttccagacggtgggggagtcggcactgagcgtagagcccttctcctaccaaggggagcctcacattgtgctggcacagcccttcgccggccgctgcctgattctctcctgggactacagcctgcagcgcttccggcccgaggaagagctgcccggtgagccccctccccgtccttctgcctgtccagcagcctgcctggctggcctgacctgcctccccacctccccacagcggcctccgtggtgtcctgcaagccactggtgctgggcccgagcctcttcgtgctggctgcccgcctgtgggggggctcacagctgtgggcccggcccagtcccggcctgcgcctggccccaacgcagaccctggccccgcggcggctgctgcggcccaatgacgccgagctcctgtggctggaagggcaaccctgcttcgtggtggccgatgcctccaaggcgggcagcaccacgctgctgtgccgcgacgggcccggcttttacccgcaccagagcctgcacgcctggcaccgggacacggacgctgaggccctggagctggacggccggccccacctgctgctggcctcggcttcccagcggcccgtgctcttccactggaccggtggccgcttcgagagacgcacagacatccccgaggccgaggatgtctatgccacacgccacttccaggctggtggggacgtgttcctgtgcctcacacgctacattggggactccatggtcatgcgctgggacggctccatgtttcgtctgctgcagcaacttccctcgcgcggtgcccacgtcttccagccactgctcatcgccagggaccagctggccatcctaggcagcgacttcgccttcagccaggtcctccgccttgagcctgacaaggggctcctggagccactgcaggagctggggcctccggccctggtggccccccgtgcctttgcccacatcactatggccggcagacgcttcctctttgctgcttgctttaagggccccacacagatctaccagcatcacgagatcgacctcagtgcctgagaccaccaacgggactctgggcatggctggggcccctggacggccccttggctggctcctggccctacttggggtgatggcccgcctgtgagctgctgaccgtgggccacgttcatcagccacacgtctaggccttaagcccacttcttaaaggatctgcacccatggggggacatagagggtcccagcctactggacctcccgagctgcccttcaggtctaaagcaacatctggacatctcggctggggcagattccccatcaaaggcaacctggggggtgcaggctggtgcactgcatggagtcgaggtggaggtcacgtgcagagctccatgaggtcccggagcccccctctcaacccgctcctaccccgctggtccctctgaaagcaccgaggggttgatggcattcctttcccattctaaactccacgcagccaatcgctttcctggaggagcgccaacctcgaagacaactcagcactgggcgggttcccctctgctgcttgtgcgcatgcgtgcggccgcccagcaagctgtgccttttgcgcctcttgcgcgtgcgccggggcacagggagggacagcgggaggtgtcgcggggagcctggtgcccttctagatgggcgacggaggcaaggacaagacgagtccgagctcaataaatgcgctgtgcaccctc

SEQ ID NO: 148371 - DNA, 2630 bp, Homo sapiens
  Payload ID: 9379
  Gene Symbol: LGI4
  Gene Name: leucine-rich repeat LGI family, member 4
  ENST ID: ENST00000587780
  CDS Start-End: 1-1136
ccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcatgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccatagagctgtcctggttccagacggtgggggagtcggcactgagcgtagagcccttctcctaccaaggggagcctcacattgtgctggcacagcccttcgccggccgctgcctgattctctcctgggactacagcctgcagcgcttccggcccgaggaagagctgcccgcggcctccgtggtgtcctgcaagccactggtgctgggcccgagcctcttcgtgctggctgcccgcctgtgggggggctcacagctgtgggcccggcccagtcccggcctgcgcctggccccaacgcagaccctggccccgcggcggctgctgcggcccaatgacgccgagctcctgtggctggaagggcaaccctgcttcgtggtggccgatgcctccaaggcgggcagcaccacgctgctgtgccgcgacgggcccggcttttacccgcaccagagcctgcacgcctggcaccgggacacggacgctgaggccctggagctggacggccggccccacctgctgctggcctcggcttcccagcggcccgtgctcttccactggaccggtggccgcttcgagagacgcacagacatccccgaggccgaggatgtctatgccacacgccacttccaggctggtggggacgtgttcctgtgcctcacacgctacattggggactccatggtgaggctgggcctgggggcggggggctggcttttcagcactgacccaatcttgcacactaagcctctaaactctgacctaccctcacatgccgacctttgaaccaggaccccaccccacactgatgccaagactctgaccccctcaaggctggctgactccgaaccactccccagtccccgacactgatgctggccccaacatcctgattctacccccaaatgctggctctgtgactcggatgcattccagacttcaccacagccacacctgtccccaccctgacactgagcccccaaggctgatgctagggttaagcactgcccactgtttctggagtgaggtgcaggcaggggagggttctgagtctggaagggccctgatctgactcaggtgttcacaaggtctctgggtggggaacagactgggggagcagggagaggagcctagaggccagggaagaggctgccaggatggtccagtcaggaggggatggagttcagccagaggtggtgggagaaatgtacaactgtagaaggtgaaactgacagagtccatggctgagtgcttctgtgtggggcgtgagggcaagggaagggctcagaacaactgcatgtgtgtggccgaacaggtgggtggtgacttttatgaagataagaaagctatgggagttttgggaccgacaggcttctgcttccaagctgttccacggcccccagagacccccgggaccccaggccctcactggccacacccccacaggtcatgcgctgggacggctccatgtttcgtctgctgcagcaacttccctcgcgcggtgcccacgtcttccagccactgctcatcgccagggaccagctggccatcctaggcagcgacttcgccttcagccaggtcctccgccttgagcctgacaaggggctcctggagccactgcaggagctggggcctccggccctggtggccccccgtgcctttgcccacatcactatggccggcagacgcttcctctttgctgcttgctttaagggccccacacagatctaccagcatcacgagatcgacctcagtgcctgagaccaccaacgggactctgggcatggctggggcccctggacggccccttggctggctcctggccctacttggggtgatggcccgcctgtgagctgctgaccgtgggccacgttcatcagccacacgtctaggccttaagcccacttcttaaaggatctgcacccatggggggacatagagggtcccagcctactggacctcccgagctgcccttcaggtctaaagcaacatctggacatctcggctggggcagattccccatcaaaggcaacctggggggtgcaggctggtgcactgcatggagtcgaggtggaggtcacgtgcagagctccatgaggtcccggagcccccctctcaacccgctcctaccccgctggtccctctgaaagcaccgaggggttgatggcattcctttcccattctaaactccacgcagccaatcgctttcctggaggagcgccaacctcgaagacaactcagcactgggcgggttcccctctgctgcttgtgcgcatgcgt

SEQ ID NO: 148372 - DNA, 1113 bp, Homo sapiens
  Payload ID: 9379
  Gene Symbol: LGI4
  Gene Name: leucine-rich repeat LGI family, member 4
  Uniprot ID: Q8N135
  ENST ID: ENST00000591633
  CDS Start-End: 184-969
accaaagacatacgaacagggaggaaggccgactgaaagaaagacggagaagaggagagagaagccagggccgagcgtgccagcaggcggatggagggcggcctggtggaggaggagacgtagtggcctgggctgagctgggtgggccgggagaagcgggtgcctcagagtgggggtgggggcatgggaggggcaggcattctgctgctgctgctggctggggcgggggtggtggtggcctggagacccccaaagggaaagtgtcccctgcgctgctcctgctctaaagacagcgccctgtgtgagggctccccggacctgcccgtcagcttctctccgaccctgctgtcactctcactcgtcaggacgggagtcacccagctgaaggccggcagcttcctgagaattccgtctctgcacctgctcctcttcacctccaactccttctccgtgattgaggacgatgcatttgcgggcctgtcccacctgcagtacctcttcatcgaggacaatgagattggctccatctctaagaatgccctcagaggacttcgctcgcttacacacctaagcctggccaataaccatctggagaccctccccagattcctgttccgaggcctggacacccttactcatgtggacctccgcgggaacccgttccagtgtgactgccgcgtcctctggctcctgcagtggatgcccaccgtgaatgccagcgtggggaccggcgcctgtgcgggccccgcctccctgagccacatgcagctccaccacctcgaccccaagactttcaagtgcagagccataggtggggggctttcccgatggggtgggaggcgggagatctgggggaaaggctgccagggccaagaggctcgtctcactccctgccctgccatttcccggagtgggaagaccctgagcaagcagcactgccttcctgagccccagttttctcatctgtaaagtgggggtaataaacagtgatataggagtgccatgggaattcaatgatacatcttcacgtgttcggcatttggcgccgggcctgggacaggaggtccttataaacgttcacccttgttaacataaaagcaaccaatttaaaaa

SEQ ID NO: 148373 - DNA, 2228 bp, Homo sapiens
  Payload ID: 9380
  Gene Symbol: LRIT1
  Gene Name: leucine-rich repeat, immunoglobulin-like and transmembrane domains 1
  Uniprot ID: Q9P2V4
  ENST ID: ENST00000372105
  CDS Start-End: 23-1894
ggccagagaggagccaggagccatgagggtggcattaggcatgctctggctcttggcccttgcgtggcccccccaggcccggggcttctgcccctctcaatgcagctgcagcctccatatcatgggtgatggcagcaaggccaggacagtagtgtgcaacgaccccgacatgaccctgcccccggcgtccatccccccggacacctccagactgcgcctggagcggacggccatacgcagggttcctggcgaggccttcaggcccctgggccgcctggagcagctgtggctgccttacaacgccctcagcgagctcaacgccctcatgctgcggggcctgcgacgcctgcgggagctgcggctgcccgggaaccgcctggccgccttcccctgggcggcgctcagggacgcccccaagctgcggctgctggacctgcaggccaaccgcctctcggctgtgcccgctgaggccgcgcgcttcctggagaacctcaccttcctcgacctctccagcaaccagctgatgaggctcccgcaggagctcatcgtctcctgggctcacctggagaccggtatctttcctcccggccaccaccccaggcgggtcctagggctacaggacaacccctgggcatgtgactgccgactctatgacctggttcatcttttggatggctgggccccaaacttggccttcattgagactgaactgagatgtgccagcccacgtagcctggccggagtggccttcagccagcttgaactgaggaagtgccagggcccagagctccatccaggagtggccagcatcaggtcccttttgggtggcacagcactgctacgctgtggagctactggagtccctgggcccgagatgagctggaggagggccaatggcaggccccttaatggtacagtgcaccaggaagtctccagtgacggcacgagctggactctgctgggcctgcctgcagtgtcccaccttgactccggagactacatctgccaagccaagaacttcctgggagcctctgaaactgttatctccttgattgtcactgagccaccgacttccacagaacacagtgggagcccaggagcactatgggcaaggacaggtggcggaggggaagctgctgcttacaacaacaagctggtggccaggcatgtcccccagattcccaaacccgctgtcctggccactggaccctctgtgcccagcacaaaggaggagctgacccttgagcacttccagatggatgccctgggagagctctctgatgggcgggcaggaccctcagaggcacgaatggtgaggtctgtgaaggtggtgggggacacttaccacagcgtgtccttggtgtggaaggcaccccaggctaagaacacaactgccttcagtgtcctctacgcggtctttgggcagcacagcatgcggcgggtgattgtgcagcctgggaagaccagagtgaccatcactgggctgttgcccaagaccaagtatgtggcgtgtgtctgtgtgcagggcctggtgccccggaaggagcagtgtgttattttctccaccaatgaagtggtggatgctgagaacactcagcagcttatcaatgtggtggtgatcagtgtggccatcgtcattgccctgcctctcacgctgcttgtctgctgcagtgctcttcagaagcgctgccgaaagtgcttcaacaaggactccactgaggccacagttacctacgtcaacctagagagactgggctacagcgaggacggcttggaggagctgtcccggcacagtgtcagcgaggctgacaggcttctctcagctcgttccagtgtggactttcaggcctttggagtcaaagggggcaggagaatcaatgagtacttctgctgagggatatgcctccgcaactcacacacctgcctgcccacgctccttctttagctctgacacctgagtacacgatcacccactcttacctgctcgggtacctgcttactcagatacttacacacaacaacagcagcagcagctgctactgcaacaaccgctaacacttgttaagcacttactacagactagaaagtgttctaagtgctaaattcttgtaacaatcatttgcagcaggcatcactattctctccatttccctggggtggggggttaagaaacttgcctgtatcagtcagcttttgctgtataacaaatgaaagcaaaatcttggtga

SEQ ID NO: 148374 - DNA, 3081 bp, Homo sapiens
  Payload ID: 9381
  Gene Symbol: LRIT2
  Gene Name: leucine-rich repeat, immunoglobulin-like and transmembrane domains 2
  Uniprot ID: A6NDA9
  ENST ID: ENST00000372113
  CDS Start-End: 7-1659
agaaatatggcttcagtttttcattacttcctgttagttctggtctttctggatacacacgcagctcagcctttctgtctgccaggatgcacttgctcagaggagagttttggcaggactctgcagtgcacatctgtctccttgggaaagatccctgggaacctttctgaagagttcaagcaagtgagaattgaaaattcacccttatttgagatgccccaagggtctttcatcaacatgagcaccttggaatacctctggctcaattttaacaatatcagtgtgatccacctaggagccctggaacacctgccagaactgagggagctgagactggaggggaacaagctctgctcagtaccatggacagcgttccgtgccacccctctcctgagggtcttggatctcaaacgcaacaagattgatgcactccctgagctggctcttcaattcttggtcagcctgacctaccttgacctatcctccaataggcttacagttgtatccaagagtgtcttcctgaactggccagcctaccagaaatgccggcagcctgactgtggggctgagattctctccagcctggtggtggccctgcatgacaacccctgggtatgtgactgtcgcctaagggggcttgtccagtttgtcaagtccattaccctcccagtcatcctggtgaattcctacctgatatgtcagggccctctgtccaaggcagggcagctttttcatgaaactgagcttagtgcttgcatgaagccacagatctcaacccccagtgccaatatcaccatccgggcaggacagaatgtgaccctgcgatgcttggcacaggccagcccctcaccatccattgcatggacttatcccctgagtatgtggagagaatttgatgtgttgacatcttctactggagaagacactgctctgtcagagctggccatacctgctgcccacctggtagacagtggtaattacacctgcatggcctccaactccattggcaagagcaaccttgtaatctctctccatgtccagcctgcccaggccctacatgcacctgattctctttccatcccctcggagggcaatgcctacattgacctgcgggttgtcaagcagacagtgcatgggattttgctggagtggcttgcagtggctgacacctctaaggaggagtggttcaccctctacattgcatcggatgaagccttcaggaaggaggtggttcacattggccccggaatcaatacttatgctgtggatgacctccttcctggcacaaaatatgaggcctgcctcagcctagagggccagcctccacaccagggccagtgtgtagcttttgtaacaggcagagatgctggtgggctagaggcacgtgagcacctcctgcatgtcacagtggtcctgtgtgtggtgctgcttgcagtgcctgtgggcgcctatgcctgggcagcccagggcccctgcagctgcagcaagtgggtcctgcgcggctgtcttcatcgcaggaaagcccccagctgcacccctgcagccccgcagtccaaggatggctcctttagagaacatccagctgtctgtgatgacggtgaagggcacatagacactgagggggacaaggagaaaggaggaacggaagacaacagctgaacaacccaggccatggggtggaaacggcttgggcttcaagcctctgaaaccaaccctctgcagcagctccatccatttatccagcaagtatatattgagcacccactgtgttccaagcactgaacttgacacagggggttcaagagtaaaaagggaaacagagtctttatcttcatgataaaggggacatagtcattatcttcgtaaagttaaagtcaatgaagatttgtccatcaaattaatcattttattatacatggtgattagaaatcactaaatattactctttgcatatacttagcctataacatttacatgcttatacgtaatgtctacgtataatattttacatatattatcctgtaaacgaaggtagacttctacccactttttataggtgaaaaactgcagcctggacagttcaatgatacacccagagtccacatctggcaggaggcagaagccccattcaaaagaggttccagttccatcgtttccttgaatgcctgttttgcggtattcttgtgtctttcattgtttataaagtgtgaccctctctcttcatgacaaactcctaatgagatcacataaatgtgatgttccaaagagctgcccatcagggtgatgagagctgttgggtaatgtgagtctctttttgtaggtgtctgttcccctgtgagcacagcccttggtgctgctgggcaggctggagccatcagcaccaaggaagagtaggggattggctgcagccctgggtctggcagagagcagactctgcagggccatacccagaaggaagagcacccatacgtccgctgctttcccctagtcaatgtctaaagccctcctatgaaatccatgagaggtggtcatttcctcttagccggacccatgtggaatggaggggccccaagaatcccaacatcagctcatcatcccactgaacagcccttctaggggagaccattcccaggatttaattcacatctgtctccctgccgtttccctcactggccacatgcaaacctttctaagagtgtaaacatgaactagactcattgtgacatctccacacgtttcctccttcccaccttttttacccattcctaatcatccttttaggcctctctcaagtgtgtacattacgtcttccacagagctttccttgacttcacacctctggggaaaaggacagtatgcacattgtgtccattggttgtgagacatttgcaggcaaagactgaccttcctcacggtggccactgcactcgtctaatacctggattgtgttcataatcaatgttagttaacaataaattttaaaaaattgaagatggctctcattttcagactaattgtccgctcatttcttcagattctactcatttgttttcttctgggcattagaaaaaaaaactctaa

SEQ ID NO: 148375 - DNA, 3177 bp, Homo sapiens
  Payload ID: 9381
  Gene Symbol: LRIT2
  Gene Name: leucine-rich repeat, immunoglobulin-like and transmembrane domains 2
  Uniprot ID: A6NDA9
  ENST ID: ENST00000538192
  CDS Start-End: 70-1752
aggatttgccactcggaagctggggcgatacttattcaaaactcacaacgtattttcttacagagaaatatggcttcagtttttcattacttcctgttagttctggtctttctggatacacacgcagctcagcctttctgtctgccaggatgcacttgctcagaggagagttttggcaggactctgcagtgcacatctgtctccttgggaaagatccctgggaacctttctgaagagttcaagcaagtgagaattgaaaattcacccttatttgagatgccccaagggtctttcatcaacatgagcaccttggaatacctctggctcaattttaacaatatcagtgtgatccacctaggagccctggaacacctgccagaactgagggagctgagactggaggggaacaagctctgctcagtaccatggacagcgttccgtgccacccctctcctgagggtcttggatctcaaacgcaacaagattgatgcactccctgagctggctcttcaattcttggtcagcctgacctaccttgacctatcctccaataggcttacagttgtatccaagagtgtcttcctgaactggccagcctaccagaaatgccggcagcctgactgtggggctgagattctctccagcctggtggtggccctgcatgacaacccctgggtatgtgactgtcgcctaagggggcttgtccagtttgtcaagtccattaccctcccagtcatcctggtgaattcctacctgatatgtcagggccctctgtccaaggcagggcagctttttcatgaaactgagcttagtgcttgcatgaagccacagatctcaacccccagtgccaatatcaccatccgggcaggacagaatgtgaccctgcgatgcttggcacaggccagcccctcaccatccattgcatggacttatcccctgagtatgtggagagaatttgatggattgctgggaggcaaacacctgacaccagtgttgacatcttctactggagaagacactgctctgtcagagctggccatacctgctgcccacctggtagacagtggtaattacacctgcatggcctccaactccattggcaagagcaaccttgtaatctctctccatgtccagcctgcccaggccctacatgcacctgattctctttccatcccctcggagggcaatgcctacattgacctgcgggttgtcaagcagacagtgcatgggattttgctggagtggcttgcagtggctgacacctctaaggaggagtggttcaccctctacattgcatcggatgaagccttcaggaaggaggtggttcacattggccccggaatcaatacttatgctgtggatgacctccttcctggcacaaaatatgaggcctgcctcagcctagagggccagcctccacaccagggccagtgtgtagcttttgtaacaggcagagatgctggtgggctagaggcacgtgagcacctcctgcatgtcacagtggtcctgtgtgtggtgctgcttgcagtgcctgtgggcgcctatgcctgggcagcccagggcccctgcagctgcagcaagtgggtcctgcgcggctgtcttcatcgcaggaaagcccccagctgcacccctgcagccccgcagtccaaggatggctcctttagagaacatccagctgtctgtgatgacggtgaagggcacatagacactgagggggacaaggagaaaggaggaacggaagacaacagctgaacaacccaggccatggggtggaaacggcttgggcttcaagcctctgaaaccaaccctctgcagcagctccatccatttatccagcaagtatatattgagcacccactgtgttccaagcactgaacttgacacagggggttcaagagtaaaaagggaaacagagtctttatcttcatgataaaggggacatagtcattatcttcgtaaagttaaagtcaatgaagatttgtccatcaaattaatcattttattatacatggtgattagaaatcactaaatattactctttgcatatacttagcctataacatttacatgcttatacgtaatgtctacgtataatattttacatatattatcctgtaaacgaaggtagacttctacccactttttataggtgaaaaactgcagcctggacagttcaatgatacacccagagtccacatctggcaggaggcagaagccccattcaaaagaggttccagttccatcgtttccttgaatgcctgttttgcggtattcttgtgtctttcattgtttataaagtgtgaccctctctcttcatgacaaactcctaatgagatcacataaatgtgatgttccaaagagctgcccatcagggtgatgagagctgttgggtaatgtgagtctctttttgtaggtgtctgttcccctgtgagcacagcccttggtgctgctgggcaggctggagccatcagcaccaaggaagagtaggggattggctgcagccctgggtctggcagagagcagactctgcagggccatacccagaaggaagagcacccatacgtccgctgctttcccctagtcaatgtctaaagccctcctatgaaatccatgagaggtggtcatttcctcttagccggacccatgtggaatggaggggccccaagaatcccaacatcagctcatcatcccactgaacagcccttctaggggagaccattcccaggatttaattcacatctgtctccctgccgtttccctcactggccacatgcaaacctttctaagagtgtaaacatgaactagactcattgtgacatctccacacgtttcctccttcccaccttttttacccattcctaatcatccttttaggcctctctcaagtgtgtacattacgtcttccacagagctttccttgacttcacacctctggggaaaaggacagtatgcacattgtgtccattggttgtgagacatttgcaggcaaagactgaccttcctcacggtggccactgcactcgtctaatacctggattgtgttcataatcaatgttagttaacaataaattttaaaaaattgaagatggctctcattttcagactaattgtccgctcatttcttcagattctactcatttgttttcttctgggcattagaaaaaaaaactctaaatt

SEQ ID NO: 148376 - DNA, 3781 bp, Homo sapiens
  Payload ID: 9382
  Gene Symbol: LRIT3
  Gene Name: leucine-rich repeat, immunoglobulin-like and transmembrane domains 3
  ENST ID: ENST00000327908
  CDS Start-End: 765-2255
cttagaccttggttagatttgaaccaaggccctcctcggcctcccaaagtgctgggattacaggcgtgagccactgcccagctgaaaattgatacatttttcaaatgagaagtatttttttcaaatgggtgttggaaagtgagtttcctcacattgttcatgttgtgacactaggttggtgctatgtaatgacatggatatgaacgagctgcctacgaacctccccgtggacactgtgaagcttcgcatagagaagactgtcatccgcagaatctctgcggaggccttctattacctggtggagctccagtatctctgggtgacttacaattccgtggccagcattgaccccagcagcttttacaacctgaagcaactgcatgagttgcgcttggatgggaattctctggctgctttcccttgggcatctctgctggacatgccccttctgaggaccctggacttgcacaataacaaaataaccagtgtgccaaatgaggcgctcaggtatctgaagaaccttgcctacttggatttatcaagcaacagactcaccacattgccaccagatttcctggagagctggactcatttagtttcaacaccttctggagtcctggacctttccccaagcaggattattcttggctgatagaacgttacggctgtaaaaagctctagcatttatctagtcaactctcccattttgccgatgagaaaacaggctcagcaaggttgcatcacccaggtcacagaattaactaatggttgagcctcatcaggaacccaggcacagtaaagttggtctacaggacaatccttggttctgtgactgtcatatttccaaaatgattgagttgtcaaaggtcgttgaccctgctatagtgcttctggatccactgatgacttgcagtgaacctgagcgcctcacaggaattttgtttcagcgggctgaattggagcattgtctgaaaccatcagtgatgacctcagccaccaaaatcatgtctgctctgggcagtaatgttctactgcggtgtgatgccactggcttccccaccccacagatcacatggaccagatctgacagctcgccagttaattatacagtaatacaagaatctccagaggaaggagtcagatggtccataatgagcttgacaggcatttcttccaaagacgctggggattacaaatgtaaggccaaaaatctggctgggatgtcagaagctgtggttactgtgacagtgcttggcattaccacaactccaataccaccagacacttctgaaagaactggagatcatcctgagtgggatgtccagccgggatctggaagatctacatctgtatctagcgcatcatcatatctttggtcctcttccttctcccccacatcttctttttctgcttctactttgtctcctccctctactgcttccttctctttatctcctttctcctcctccactgtttcttcaaccacaactctgagcacaagcatctcagcaagtaccaccatggccaacaagcgatcattccagctccaccaaggtgggaaaagaaatttaaaggtggcaaagaatggaagtaagcttcctccagccagcacaagtaagaaagaagagctggcattgttggatcaaacaatgcttacggagacaaatgccgcaatagaaaacctcagggtggtcagtgagactaaagagagtgtgacattgacgtggaatatgatcaacaccacacataactctgcagtgactgtgttgtattccaagtatggtgggaaggacctgctgctgttgaatgcagactccagcaagaaccaagtaaccatagatggcttggaacccggtgggcaatacatggcctgtgtctgtccaaaaggagtgcctccccagaaagaccaatgcatcaccttttctactgaaagagttgaaggagatgattctcaatggtctctccttctcgtggtgaccagtactgcctgtgttgttatcttaccattgatttgtttcttgttgtacaaagtttgcaaactgcaatgtaaatcagaacctttttgggaagatgatttggcaaaggagacttatatccaatttgagaccctgtttcccaggtctcaaagtgtaggtgagctctggacacgaagccacagggatgactcagagaaattgctgctttgttctaggtcaagtgtggaatctcaggtgacttttaaaagtgaaggttccagaccagagtattattgctaaggttctgcagctcaggtgcatgtgagctacaaaactagcatctaagggtataattgaccctaggtttggatgacttttggacagactttcacattgtacatgaaaatcacaaatggaatgcttttaagtatgtttaaaaaataccatgagacctctgaactgaaaagacaaataatgttgattttttttcttgtgtggaaaaggtctacagaaataatttttagagtggtgcttaataaattattaatactttttagggtaatgttttagttcttaaaaataagttcatgtgaaagtagcaagtgaactctgtatttaaaaatatagttttttgagtcatgaggaaacattagcaaaaccagctaagccttgatgtttattcatgttcgaagtgcattatagcatttgctgtggatgttttctgacattgcctaatggagagcgtgggatcataaaggattttgtgttcactaaggttaaatctaactcacgggagagagagggctctgtctcttggtaccattatgcattgtgatactatagagttgtgttcatatttcttgtaagaaaaatttttgcttttctttagaaatataggtattagcaaaagtaagtatacaaagaggattatgacaaatagaccatttctttaaaaatggtaactgttgcatttaaacacatcgactgacagattatatggatatttaaaaataactttaaatcaatcttttaatattttgctgtttgctcttatgttctcccttctttcttccttccttgtcttccctccctttccttccttcattctttctttcttctgctctgtcagaagatatacaagtagccaaagcatcacgagccaagctgtttgtcttttgccatattgtcttttgattctcttgataaagagaaagcttttgaaattacttactgccctttgaaagtctgttttacaaccccaaaggatattttaggactttaaaagggaagcttcagtggattcatttggttagattcttttcctaggttaaaaacatcggggaacttaaatacataggaaaggagttcacaaataaaatttagtttttttagaaagagaatattttaataactgtagtatactacaagaaacatctcatggctttaagattaacgatagcgataaggcccactcaagcatctcacagtggtgatattacatgtcacttagcaggatgcaacctggcctagggatttccagaagacaaggccacctcagcacagatgcaactttcataaattttagaacaaagcctaaccttactagattaaacttgctctatgaaagaaacacttggtaattgacccagactgaatacatgtataagaaatgggaaagatctcccaaactctgagaacggtcctcaaatagaagctctcctagtcagttggtcatctgacctctgactatatccggcctatgacaccagccagctcctgctttctgtcttgtaagagcactgctggaataaactacttgagcatta

SEQ ID NO: 148377 - DNA, 3566 bp, Homo sapiens
  Payload ID: 9382
  Gene Symbol: LRIT3
  Gene Name: leucine-rich repeat, immunoglobulin-like and transmembrane domains 3
  Uniprot ID: Q3SXY7
  ENST ID: ENST00000594814
  CDS Start-End: 1-2040
atgcatctctttgcatgtctgtgcattgtccttagctttttggaaggagtgggctgtttgtgtccttcacagtgcacctgtgattatcacggcagaaatgacggctcaggatcaaggttggtgctatgtaatgacatggatatgaacgagctgcctacgaacctccccgtggacactgtgaagcttcgcatagagaagactgtcatccgcagaatctctgcggaggccttctattacctggtggagctccagtatctctgggtgacttacaattccgtggccagcattgaccccagcagcttttacaacctgaagcaactgcatgagttgcgcttggatgggaattctctggctgctttcccttgggcatctctgctggacatgccccttctgaggaccctggacttgcacaataacaaaataaccagtgtgccaaatgaggcgctcaggtatctgaagaaccttgcctacttggatttatcaagcaacagactcaccacattgccaccagatttcctggagagctggactcatttagtttcaacaccttctggagtcctggacctttccccaagcaggattattcttggtctacaggacaatccttggttctgtgactgtcatatttccaaaatgattgagttgtcaaaggtcgttgaccctgctatagtgcttctggatccactgatgacttgcagtgaacctgagcgcctcacaggaattttgtttcagcgggctgaattggagcattgtctgaaaccatcagtgatgacctcagccaccaaaatcatgtctgctctgggcagtaatgttctactgcggtgtgatgccactggcttccccaccccacagatcacatggaccagatctgacagctcgccagttaattatacagtaatacaagaatctccagaggaaggagtcagatggtccataatgagcttgacaggcatttcttccaaagacgctggggattacaaatgtaaggccaaaaatctggctgggatgtcagaagctgtggttactgtgacagtgcttggcattaccacaactccaataccaccagacacttctgaaagaactggagatcatcctgagtgggatgtccagccgggatctggaagatctacatctgtatctagcgcatcatcatatctttggtcctcttccttctcccccacatcttctttttctgcttctactttgtctcctccctctactgcttccttctctttatctcctttctcctcctccactgtttcttcaaccacaactctgagcacaagcatctcagcaagtaccaccatggccaacaagcgatcattccagctccaccaaggtgggaaaagaaatttaaaggtggcaaagaatggaagtaagcttcctccagccagcacaagtaagaaagaagagctggcattgttggatcaaacaatgcttacggagacaaatgccgcaatagaaaacctcagggtggtcagtgagactaaagagagtgtgacattgacgtggaatatgatcaacaccacacataactctgcagtgactgtgttgtattccaagtatggtgggaaggacctgctgctgttgaatgcagactccagcaagaaccaagtaaccatagatggcttggaacccggtgggcaatacatggcctgtgtctgtccaaaaggagtgcctccccagaaagaccaatgcatcaccttttctactgaaagagttgaaggagatgattctcaatggtctctccttctcgtggtgaccagtactgcctgtgttgttatcttaccattgatttgtttcttgttgtacaaagtttgcaaactgcaatgtaaatcagaacctttttgggaagatgatttggcaaaggagacttatatccaatttgagaccctgtttcccaggtctcaaagtgtaggtgagctctggacacgaagccacagggatgactcagagaaattgctgctttgttctaggtcaagtgtggaatctcaggtgacttttaaaagtgaaggttccagaccagagtattattgctaaggttctgcagctcaggtgcatgtgagctacaaaactagcatctaagggtataattgaccctaggtttggatgacttttggacagactttcacattgtacatgaaaatcacaaatggaatgcttttaagtatgtttaaaaaataccatgagacctctgaactgaaaagacaaataatgttgattttttttcttgtgtggaaaaggtctacagaaataatttttagagtggtgcttaataaattattaatactttttagggtaatgttttagttcttaaaaataagttcatgtgaaagtagcaagtgaactctgtatttaaaaatatagttttttgagtcatgaggaaacattagcaaaaccagctaagccttgatgtttattcatgttcgaagtgcattatagcatttgctgtggatgttttctgacattgcctaatggagagcgtgggatcataaaggattttgtgttcactaaggttaaatctaactcacgggagagagagggctctgtctcttggtaccattatgcattgtgatactatagagttgtgttcatatttcttgtaagaaaaatttttgcttttctttagaaatataggtattagcaaaagtaagtatacaaagaggattatgacaaatagaccatttctttaaaaatggtaactgttgcatttaaacacatcgactgacagattatatggatatttaaaaataactttaaatcaatcttttaatattttgctgtttgctcttatgttctcccttctttcttccttccttgtcttccctccctttccttccttcattctttctttcttctgctctgtcagaagatatacaagtagccaaagcatcacgagccaagctgtttgtcttttgccatattgtcttttgattctcttgataaagagaaagcttttgaaattacttactgccctttgaaagtctgttttacaaccccaaaggatattttaggactttaaaagggaagcttcagtggattcatttggttagattcttttcctaggttaaaaacatcggggaacttaaatacataggaaaggagttcacaaataaaatttagtttttttagaaagagaatattttaataactgtagtatactacaagaaacatctcatggctttaagattaacgatagcgataaggcccactcaagcatctcacagtggtgatattacatgtcacttagcaggatgcaacctggcctagggatttccagaagacaaggccacctcagcacagatgcaactttcataaattttagaacaaagcctaaccttactagattaaacttgctctatgaaagaaacacttggtaattgacccagactgaatacatgtataagaaatgggaaagatctcccaaactctgagaacggtcctcaaatagaagctctcctagtcagttggtcatctgacctctgactatatccggcctatgacaccagccagctcctgctttctgtcttgtaagagcactgctggaataaactacttgagcatta

SEQ ID NO: 148378 - DNA, 4710 bp, Homo sapiens
  Payload ID: 9383
  Gene Symbol: LRCH1
  Gene Name: leucine-rich repeats and calponin homology (CH) domain containing 1
  Uniprot ID: Q9Y2L9
  ENST ID: ENST00000311191
  CDS Start-End: 230-2320
ccgcagtccttagcttcccggggacaggaaaccttcaagaccgagctgccacggccgcctccccgcccgccccccattctacgcgcctgcccacaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcacgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatctttccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcatgccgaaaattaggagtaccagaggaaaagctatgtctcccccaccacatccttgaagaaaaaggcctggtcaaagtgggcattaccattcaagcattactagacatcaccgtaacgaaggctctgttcacatgaaactaccccttctccattgggggctcagactctgctctcatccaggatcctgaactctgctccaggcacctgttcaaccctctctcccacccactgcctgtcacttcactgactccagttacattgaaacaattttcagtctaagggaggattttctacctttcagagctgacctccgactttaagacttgacaggtatttatcttgaaaccagagagggagctggaggaaaaaaaaactgagcagcacatcaatgccttttccaccctccttcatcctttccacactcaccgactgccattaccaaaacgccaagcacaaccgttttgcagcaagacgcattcgttttattaaaaccaaactcgttatgtatttagtggggggaggggggcacaatcaggtttttcaccaccaaatttttcgagaggtttcttgagaccattgccttttaaaaaactattttcgacatacaaaatatttatataaatattatttattagtgagttgttattcatcctttggatgcaaattgtaaattaggaaactattttattactgcttttttgtggttaaacactttattttaatataaatgttgagttattttctatcctctttggtgtgcggtagtttaggtctcagtaatgtttctggtatatatgattccaaaaaaaagcgaaaaacaggtgcttttaggacacaacttttctggggaggcaatattgacactttggtttgtggaacgttggtcttatttatatttctgcattccatccagtttcctacattccagcagccctctgtcccccaatataatgaactgactaaaatcaagagagcaccccaaagttatttgtaaatagctgtgatggaaaaaaaaaagacatattaaacttgaagctaaaatgtgaacaattattttttggattcatacttcttttgctatgcacaaaacattcacgttttaacacaaagaaataataagtgttagcatcgtgtgtcttgaagtatacttttgcactgtaacttgggttacgttaaagagagcttagcaccaaaggtagataatgaagaaatggcataggaaagtggagatgataaaaagttgattgttgaaccaaaaagggtttgaagggaagcttcgactgagtatcagaaattacttaaggcacataggacctgaatcaggaaaccagcacttcttacaactgccagttttaaaagaggaaatgattctgagatgtgctcattttattttaatttggtggttggtggttttccaagtagtctgtaaaatcctgcaagattcacagtctctggtgtgaaacctcagaagtgagtcgttgtgagcctgtgggcagcaccaccaaggcaggctaaggggagggtgcagtaagtggagtttgtgaggctgagtggctgaggagggagcaagtgcaacaaaatagggctagagaagaaccagccaaggagtggaacccatgctgctctcagagattcacggaacacggcagccttctgcaggcagttccatgcatgtgcactcacgctgcaatcacagatgtcccagtaattaacctttctaagtcttgtgaatgctgactgcactttcacctcctcgaaaagccattggaagtttttagagcagcagcagccacagtttgtaagacaaatgtagagggggacgcaaaagaaaagacaccaccaggaggaggattcagtgtgcagtcagcacagaccaacatcaaccaaggcaatggctgccctccactcttgggaagatggggggaggtttctgaaaacggaaatttggattggcagctagcagttatttcctatcagatgtactgtgcactttaacctaacttaaaatgtattttaatatttttctgtactgcacaaatacctgttttgtcaaatagcataatgatgtaaagaaacattttggacaaagagtgtatacaatttaagcaacattcaaaggttgactatataagtaggagtttagcctgctgcaccttcacgggcattcagaatgcggggtcctgaaatattttcttacgtgtatatatggtagcatgaagctttgtaatcattgttttgagagatttttttttcaaaattaaagtatttcttttgatattaatttttattattttcttgaagttggttgtgtaatgtaaatggcttcagtcttctgtaaaattgcttttttttcttttaaatgcagtccttctatggctaagacgtcttcaagatccttgtacactgtttatatgtgcaataaaatgcatggccagctgacagtatcgtcagtggacagaatgtatatagtgcaaatatccttccttttattatttaacagccattaaaatcttggatttgtacaa

SEQ ID NO: 148379 - DNA, 3314 bp, Homo sapiens
  Payload ID: 9383
  Gene Symbol: LRCH1
  Gene Name: leucine-rich repeats and calponin homology (CH) domain containing 1
  Uniprot ID: Q9Y2L9
  ENST ID: ENST00000389797
  CDS Start-End: 138-2429
acaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcacgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatctttccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagacccagccctcattcttcctcctatctccttcaacacacttacacaggcacagacatgggacagctctagctacagtgttccatctgaaggagacagtgacaatgtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcatgccgaaaattaggagtaccagaggctgacctctgctctccgtgtgacatcctgcagttggattttcgtcacattcgaaagactgttgacactctgctggcactcggggagaaagccccaccaccaacttctgccctccgctccagggaccttataggcttctgtcttgtccatattctctttatagtgctggtctatatcacttaccactggaatgctctgtccgcataatgtctgcacgtgcatccaaacgctgtgctctgtcgccctcaacctttgcagggtccttcctacctttgagcctttgccttgcaaacttccatccctgtcatgtcttcagttatctctcgagttttgaagctgaacagtagcaaatcagattttccagaagcacaaactttgtagaatacagtttagtataattcctctcacttactgaaatacaacgacgacgactgcaaagtgtatgcacaccgcatgcttcctcatccacatagtgccagcagcagtgccacgcagttcctcctctccctcccggtgagctgctgccctgggcagaggggaggagaattccaggacaagagtgtcaaggacagggatttagcatatggaagtctttcctttgggtcagtattgaactagaattctaattcgggactgggcaattgagctgtataggggccaccttgcagggaggacagaaaactaacattttggcccaacttgatctatacaaaactttaataataccactactgaccaagttggacgtgtacacgtactcacactgccttgatggccattcgattggattcctcccaaatttcctaaaaagggagccgcgaagggcgctgggcagtgtggccgccaacttccaccccggcaagcccctctgtcctatgcagaagggcgctcaagggaaggaagtgtcgttgctgttagagcctcacgtggaggagtcacttaaacaccagttttttactgcttaattccttgttaggtcttctcttgaggctcttagaaaagcgttttccagagagatttctatttttgaacaatggaacggatcactgcttttttgccacatcacatagtaactgccggtccagaatgtga

SEQ ID NO: 148380 - DNA, 4131 bp, Homo sapiens
  Payload ID: 9383
  Gene Symbol: LRCH1
  Gene Name: leucine-rich repeats and calponin homology (CH) domain containing 1
  Uniprot ID: Q9Y2L9
  ENST ID: ENST00000389798
  CDS Start-End: 198-2384
cttcaagaccgagctgccacggccgcctccccgcccgccccccattctacgcgcctgcccacaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcacgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatctttccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcatgccgaaaattaggagtaccagaggctgacctctgctctccgtgtgacatcctgcagttggattttcgtcacattcgaaagactgttgacactctgctggcactcggggagaaagccccaccaccaacttctgccctccgctccagggaccttataggcttctgtcttgtccatattctctttatagtgctggtctatatcacttaccactggaatgctctgtccgcataatgtctgcacgtgcatccaaacgctgtgctctgtcgccctcaacctttgcagggtccttcctacctttgagcctttgccttgcaaacttccatccctgtcatgtcttcagttatctctcgagttttgaagctgaacagtagcaaatcagattttccagaagcacaaactttgtagaatacagtttagtataattcctctcacttactgaaatacaacgacgacgactgcaaagtgtatgcacaccgcatgcttcctcatccacatagtgccagcagcagtgccacgcagttcctcctctccctcccggtgagctgctgccctgggcagaggggaggagaattccaggacaagagtgtcaaggacagggatttagcatatggaagtctttcctttgggtcagtattgaactagaattctaattcgggactgggcaattgagctgtataggggccaccttgcagggaggacagaaaactaacattttggcccaacttgatctatacaaaactttaataataccactactgaccaagttggacgtgtacacgtactcacactgccttgatggccattcgattggattcctcccaaatttcctaaaaagggagccgcgaagggcgctgggcagtgtggccgccaacttccaccccggcaagcccctctgtcctatgcagaagggcgctcaagggaaggaagtgtcgttgctgttagagcctcacgtggaggagtcacttaaacaccagttttttactgcttaattccttgttaggtcttctcttgaggctcttagaaaagcgttttccagagagatttctatttttgaacaatggaacggatcactgcttttttgccacatcacatagtaactgccggtccagaatgtgacggattcgactctattcattttcaaataaagccatgagccgtggaacattcttggtcctggtgcttgggttatgatggcaggagtcaagaagaagattactttcattctagaagaatgtagtttctctaattatttgaaatgttcatttagcctttgattttcactgatattaactagcaaactgctttaagtcagctcaaaggattatatagtaactatatctgcatttggagcaatgtgatcagtttgcatttaaaaggaaaaaaaagaattttatcttagccagaatgtccctggattcaggggtgtctttgtataatatgagagggccttgttccaaggtcaaggcagcctccttattttacatgctgtttgccaaatcttgtttcttagcttggggagatgatggacttagcttcctcaagataaatttctagtttattaagatgcaaacagctctcatagatggctactacgaagaaaatcttatttttctgaacattttcatgaatccaggggacttgaaaatatggaagacccacatagttagaagaatatatttataaagattccttgctgctaagtcagatcagatttgctaacaggaagcattctttacatgacagtatcttgagttatgtgagttttttttcctcctgactttgtgttgattggtgaaatgcagggtatgtggaagttatctaattaacctcagttgtatatgaataacccacagatgtactgaattacttttggtgctatcttgtactcttcaatctgtaacacaataaaatccctttgtacgatgtctaatgagcaccctgagccataaattgcttaataaacacattttgggtgatt

SEQ ID NO: 148381 - DNA, 554 bp, Homo sapiens
  Payload ID: 9383
  Gene Symbol: LRCH1
  Gene Name: leucine-rich repeats and calponin homology (CH) domain containing 1
  ENST ID: ENST00000463929
  CDS Start-End: 261-554
atcgggtggtatccattgagcactgtcctggtgaggacaggttgatagatcacctgaagccttttagatgagaccaggatgtcagctgcaacgagatcacagcgttgccccagcagataggtcagttgaaatctctacgagaactgaatgtcagaagaaattaccttaaagttttaccacaagaactagtagatctttccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtca

SEQ ID NO: 148382 - DNA, 545 bp, Homo sapiens
  Payload ID: 9383
  Gene Symbol: LRCH1
  Gene Name: leucine-rich repeats and calponin homology (CH) domain containing 1
  ENST ID: ENST00000478412
  CDS Start-End: 329-545
gaaacgaggctctgctgccttctatggtgaaaggggagagcttttccaggttcaaaagtaaagcgggatatttaaggccttgatctcactggaatcatttgtatctttagttctgtgatgccaagtgggacctgcatgggatttggatgtcagctgcaacgagatcacagcgttgccccagcagataggtcagttgaaatctctacgagaactgaatgtcagaagaaattaccttaaagttttaccacaagaactagtagatctttccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaa

SEQ ID NO: 148383 - DNA, 4929 bp, Homo sapiens
  Payload ID: 9384
  Gene Symbol: LRCH2
  Gene Name: leucine-rich repeats and calponin homology (CH) domain containing 2
  Uniprot ID: Q5VUJ6
  ENST ID: ENST00000317135
  CDS Start-End: 32-2329
attgtcgggggctattctctctcccaggaacatggcggcgagtcagggaggaggcggtaacagtgggggcggcggttgtggtggaggtggaagtagcggtggctgtggcacggctggagggggaggtggcggggctggagggggaggcggcggcggcggcgggaccctggtggtccccatcccggtaccgactcttttcggtcagccgttccccaacgggccgccgtggaacccggggagcctgcagcctcagcacaccgtgaggagcctggaccgggccctggaagaggcgggcagctccggcatcctgagcctcagtggtcggaaactccgagacttcccgggcagcggctacgacctgacggacaccacccaagcagatctttccagaaatcgttttacagaaattccttctgatgtctggttatttgcaccccttgaaacattaaatttatatcataattgcatcaaaaccattcctgaagccattaaaaatctgcagatgttaacataccttaacattagccgaaatcttttatcaacattgccaaaatacctatttgatcttccccttaaagttttggtcgtcagtaataataaactggtatccattccagaagaaattgggaagttaaaagatttaatggaattggatattagctgcaatgagattcaagtccttccccaacaaatgggaaaattacattcacttagagagctaaatataagaagaaataatcttcatgttttgccagatgaattaggagaccttcccttagtcaagctggatttctcttgtaataaagtgaccgaaattccagtttgttacagaaagctgcatcatttacaagtaataattttggataacaatccattgcaagtaccaccagcacagatatgtttaaagggtaaggtgcacatatttaagtacttaaatattcaagcatgttgcagaatggataagaaaccagattccctggatcttccatcattgagtaaacgaatgccctcacagcctctcacagacagtatggaagatttttatccaaataaaaatcatggccctgactctggaattggaagtgataatggagagaaacgattatccacaacagaaccatcagatgatgacacagtcagccttcattctcaagtctcagaatcaaatagagagcagacatcaagaaatgacagtcacataataggaagtaagactgattctcagaaagaccaggaggtatatgattttgttgaccccaacacagaagatgtagcagttcctgaacagggaaatgcacatattggatcatttgtatcattctttaagggaaaagaaaaatgttctgaaaaatctcggaaaaatgaagaattaggagatgaaaaaagacttgagaaagaacagttactggcagaggaagaggatgatgatttgaaggaagtaactgatttgaggaaaatagctgctcagttattgcagcaagaacagaagaacaggattcttaatcattcaacttctgtgatgagaaacaagccaaaacaaactgtggaatgtgaaaagagtgtctcagcagatgaagttaattcaccattatcacccctcacctggcagcccttagaaaatcagaaggatcaaatagatgaacaaccgtggccagaatctcaccctataatctggcagagtgaagaaaggaggcggagcaaacagattagaaaagaatatttcaagtataaatcaatgaggaagagttcaagtggcaatgaaaatgatgagcaagacagtgataatgctaatatgtcaacacaatctccagtatcatctgaggaatatgacagaactgatggtttttcacacagtccctttggcttgaagcctagatcagcttttagccgctcatctcgccaagaatatggggcagcagatccaggatttacaatgagaagaaagatggaacatttacgggaagagcgagagcaaatacgacaacttcgcaacaatcttgaatccaggttaaaagtaattttgcctgatgacattggagctgcactgatggatggggttgttctttgccatttagccaatcatataaggccacgttctgttgctagtattcatgtaccatcaccagcagtgcccaaactgagcatggcaaaatgtcgaagaaatgtagaaaattttcttgatgcttgtaaaaagttgggtgtctcacaggaaagactttgtttgcctcatcatattttggaagaacgaggacttgtgaaagttggtgtcacagttcaggcgctccttgaattaccaacaaccaaggcatctcagctttctgtggcttaatataacattttaaaattctaagtgtatagtttcatttatttgaagtgatttcaaatatttcaaattcatgaataagaatattccgtcaaaaatagtttgccttaggtcacgccttaggattttaaaaaaattacattgaaacatcaaacttaaacattgaattgcccgaacttctttgggggaaaactggattaacttaataagagtatttgataaactcaaattctctttttactaagtcagttgataatcttgattatttttcagaaagcagactgatactaaatttaaaatgtagtttcaatttaataatcacattaggtttaatttttttacatcatagcatattagtaaacatctggataaaggtaattttttttagcaatttagagcaattctatatttgagttatttaatacacttctaattctagtttatacacaatttcttcaatctttggtcttagttttctagaaaaaaggagtagaaaaaacaattctggctttatattaaattcttttagtattataggttggtgccaaaatattttcagttgtactgtagattgtttacatgtgaagtgcctgtgtaattgatgactcttacatagtcttaagcatttttgcaattttttaaatgtattaatagagtcaatggaactttaaaatattttagtagattttgtaaagtcagtaatatgtgaggatttaaatgagcctcacattgtgacatttgtggttttttagttagtccattgcagtttcccttaaattggttatttcatgttgtcaaaaataccaatgttaatatgattaatttatgctatttaattttgtgaaacttaatcatcttttaaaatgtattatttgaagagtattttatttctgtattgaaaatgttacacaaagcagtaaagtttttgagaactagtgaagtactaattatcaaggacattttgataaaactgccaaagtttgggtttatatcttccctttgagcagcattctatcagtgctgcctttagctatactcagagagcagcagttgaggaataggtttttactcaaaatctggccatttgtgaatcctgtaaaccttgtgatcttcaattactttgatgttaaattaaacacagactcttctataaatattttcatgagatactgtgttacacaaagtccttgttttaacttaggtatgggtaaatttacattggtggtattgcaggaatttttcaaaaacattactgtaatgaataactgagtttcctatagaagaacctgaataattacttttgtagtaaccaagcaagcatcatatcttaagtatgtgatcatttgcacttgttacctcttaatatggatgcaacttattaaaaatgttggcctgggtatttcaaagggtatatataaaaggtaaaaaactagtgtgccaaatggtataggaacaactgtactttttttgatcagttggcatgaagccatagaattaaattttggctttagaatacagatgtgttcattacattccccaagggtcaaattggagcttttaaagaattaaagcttctatgagtatatggtttaagaattaaattattagtaatttattattttaaatatttgacctcattagttgttaattttttagttggataaaaaaaaaactcgctgacataatctccctagtgaaaacttgggtaatatatgtaagaaatggcaaataaataccttagttaatgactttttatgtagaaatttgacagcattacaaattaagtgaccattaaaaacacagcaatcattcatactgctttcataggtgttatgatagtctctgattaatcaatctagtatgaattattttacaagtgttgtcctgtttcatatctttgaagtagtagtgaaattgtaggccattttcttataacatttcagttacttttcagttaattattcctttaaaaagaaaatacagcagaacctcactgtagcattctttactgcagagcaaaattcaatttaagatgggcttctctgaggtccacatcatggcagttcatttactcttgtgccaaatggcaacaccacgtctaaagcagtttcacagcatggtcccctacaatgttataccaaggctctgatgtatttcttttagtagtttctaagtgtaaaatttattctaaatgtttttatggctattatctatttcatcagttattgaattaagaatgattttcattacttgagtgggatttgtgatttaatgacagttgaataatcaaaaatattttattaggcccccaaaatttaatagatatctatttctgttacattttattactgtatggcacaagaaagaagtgacattgggtatgttagaaatgaaataaggagtaaaaatgcattaccatttgtttaataattatctttacagaatgctagtttaatgacttttttaactgaattttttgaataaatcagaaatgtttgtattggtcacagatctatcataattgcttttctgatgcatttaaaaataaatggaacacttaaatgtatattaccgatgcaaactgtggataaagttgaaagaaaaaa

SEQ ID NO: 148384 - DNA, 4868 bp, Homo sapiens
  Payload ID: 9384
  Gene Symbol: LRCH2
  Gene Name: leucine-rich repeats and calponin homology (CH) domain containing 2
  Uniprot ID: Q5VUJ6
  ENST ID: ENST00000538422
  CDS Start-End: 32-2278
attgtcgggggctattctctctcccaggaacatggcggcgagtcagggaggaggcggtaacagtgggggcggcggttgtggtggaggtggaagtagcggtggctgtggcacggctggagggggaggtggcggggctggagggggaggcggcggcggcggcgggaccctggtggtccccatcccggtaccgactcttttcggtcagccgttccccaacgggccgccgtggaacccggggagcctgcagcctcagcacaccgtgaggagcctggaccgggccctggaagaggcgggcagctccggcatcctgagcctcagtggtcggaaactccgagacttcccgggcagcggctacgacctgacggacaccacccaagcagatctttccagaaatcgttttacagaaattccttctgatgtctggttatttgcaccccttgaaacattaaatttatatcataattgcatcaaaaccattcctgaagccattaaaaatctgcagatgttaacataccttaacattagccgaaatcttttatcaacattgccaaaatacctatttgatcttccccttaaagttttggtcgtcagtaataataaactggtatccattccagaagaaattgggaagttaaaagatttaatggaattggatattagctgcaatgagattcaagtccttccccaacaaatgggaaaattacattcacttagagagctaaatataagaagaaataatcttcatgttttgccagatgaattaggagaccttcccttagtcaagctggatttctcttgtaataaagtgaccgaaattccagtttgttacagaaagctgcatcatttacaagtaataattttggataacaatccattgcaagtaccaccagcacagatatgtttaaagggtaaggtgcacatatttaagtacttaaatattcaagcatgttgcagaatggataagaaaccagattccctggatcttccatcattgagtaaacgaatgccctcacagcctctcacagacagtatggaagatttttatccaaataaaaatcatggccctgactctggaattggaagtgataatggagagaaacgattatccacaacagaaccatcagatgatgacacagtcagccttcattctcaagtctcagaatcaaatagagagcagacatcaagaaatgacagtcacataataggaagtaagactgattctcagaaagaccaggaggtatatgattttgttgaccccaacacagaagatgtagcagttcctgaacagggaaatgcacatattggatcatttgtatcattctttaagggaaaagaaaaatgttctgaaaaatctcggaaaaatgaagaattaggagatgaaaaaagacttgagaaagaacagttactggcagaggaagaggatgatgatttgaaggaagtaactgatttgaggaaaatagctgctcagttattgcagcaagaacagaagaacaggattcttaatcattcaacttctgtgatgagaaacaagccaaaacaaactgtggaatgtgaaaagagtgtctcagcagatgaagttaattcaccattatcacccctcacctggcagcccttagaaaatcagaaggatcaaatagatgaacaaccgtggccagaatctcaccctataatctggcagagtgaagaaaggaggcggagcaaacagattagaaaagaatatttcaagtataaatcaatgaggaagagttcaagtggcaatgaaaatgatgaggaatatgacagaactgatggtttttcacacagtccctttggcttgaagcctagatcagcttttagccgctcatctcgccaagaatatggggcagcagatccaggatttacaatgagaagaaagatggaacatttacgggaagagcgagagcaaatacgacaacttcgcaacaatcttgaatccaggttaaaagtaattttgcctgatgacattggagctgcactgatggatggggttgttctttgccatttagccaatcatataaggccacgttctgttgctagtattcatgtaccatcaccagcagtgcccaaactgagcatggcaaaatgtcgaagaaatgtagaaaattttcttgatgcttgtaaaaagttgggtgtctcacaggaaagactttgtttgcctcatcatattttggaagaacgaggacttgtgaaagttggtgtcacagttcaggcgctccttgaattaccaacaaccaaggcatctcagctttctgtggcttaatataacattttaaaattctaagtgtatagtttcatttatttgaagtgatttcaaatatttcaaattcatgaataagaatattccgtcaaaaatagtttgccttaggtcacgccttaggattttaaaaaaattacattgaaacatcaaacttaaacattgaattgcccgaacttctttgggggaaaactggattaacttaataagagtatttgataaactcaaattctctttttactaagtcagttgataatcttgattatttttcagaaagcagactgatactaaatttaaaatgtagtttcaatttaataatcacattaggtttaatttttttacatcatagcatattagtaaacatctggataaaggtaattttttttagcaatttagagcaattctatatttgagttatttaatacacttctaattctagtttatacacaatttcttcaatctttggtcttagttttctagaaaaaaggagtagaaaaaacaattctggctttatattaaattcttttagtattataggttggtgccaaaatattttcagttgtactgtagattgtttacatgtgaagtgcctgtgtaattgatgactcttacatagtcttaagcatttttgcaattttttaaatgtattaatagagtcaatggaactttaaaatattttagtagattttgtaaagtcagtaatatgtgaggatttaaatgagcctcacattgtgacatttgtggttttttagttagtccattgcagtttcccttaaattggttatttcatgttgtcaaaaataccaatgttaatatgattaatttatgctatttaattttgtgaaacttaatcatcttttaaaatgtattatttgaagagtattttatttctgtattgaaaatgttacacaaagcagtaaagtttttgagaactagtgaagtactaattatcaaggacattttgataaaactgccaaagtttgggtttatatcttccctttgagcagcattctatcagtgctgcctttagctatactcagagagcagcagttgaggaataggtttttactcaaaatctggccatttgtgaatcctgtaaaccttgtgatcttcaattactttgatgttaaattaaacacagactcttctataaatattttcatgagatactgtgttacacaaagtccttgttttaacttaggtatgggtaaatttacattggtggtattgcaggaatttttcaaaaacattactgtaatgaataactgagtttcctatagaagaacctgaataattacttttgtagtaaccaagcaagcatcatatcttaagtatgtgatcatttgcacttgttacctcttaatatggatgcaacttattaaaaatgttggcctgggtatttcaaagggtatatataaaaggtaaaaaactagtgtgccaaatggtataggaacaactgtactttttttgatcagttggcatgaagccatagaattaaattttggctttagaatacagatgtgttcattacattccccaagggtcaaattggagcttttaaagaattaaagcttctatgagtatatggtttaagaattaaattattagtaatttattattttaaatatttgacctcattagttgttaattttttagttggataaaaaaaaaactcgctgacataatctccctagtgaaaacttgggtaatatatgtaagaaatggcaaataaataccttagttaatgactttttatgtagaaatttgacagcattacaaattaagtgaccattaaaaacacagcaatcattcatactgctttcataggtgttatgatagtctctgattaatcaatctagtatgaattattttacaagtgttgtcctgtttcatatctttgaagtagtagtgaaattgtaggccattttcttataacatttcagttacttttcagttaattattcctttaaaaagaaaatacagcagaacctcactgtagcattctttactgcagagcaaaattcaatttaagatgggcttctctgaggtccacatcatggcagttcatttactcttgtgccaaatggcaacaccacgtctaaagcagtttcacagcatggtcccctacaatgttataccaaggctctgatgtatttcttttagtagtttctaagtgtaaaatttattctaaatgtttttatggctattatctatttcatcagttattgaattaagaatgattttcattacttgagtgggatttgtgatttaatgacagttgaataatcaaaaatattttattaggcccccaaaatttaatagatatctatttctgttacattttattactgtatggcacaagaaagaagtgacattgggtatgttagaaatgaaataaggagtaaaaatgcattaccatttgtttaataattatctttacagaatgctagtttaatgacttttttaactgaattttttgaataaatcagaaatgtttgtattggtcacagatctatcataattgcttttctgatgcatttaaaaataaatggaacacttaaatgtatattaccgatgcaaactgtggataaagttg

SEQ ID NO: 148385 - DNA, 2258 bp, Homo sapiens
  Payload ID: 9385
  Gene Symbol: LRCH3
  Gene Name: leucine-rich repeats and calponin homology (CH) domain containing 3
  Uniprot ID: Q96II8
  ENST ID: ENST00000334859
  CDS Start-End: 6-2144
gggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacagttcatcattcccctgcatattcttttcctgctgctatccagagaaatcagcctcagcgccctgaaagcttccttttccgagcaggtgtcagggcagaaaccaacaaaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctac

SEQ ID NO: 148386 - DNA, 2970 bp, Homo sapiens
  Payload ID: 9385
  Gene Symbol: LRCH3
  Gene Name: leucine-rich repeats and calponin homology (CH) domain containing 3
  Uniprot ID: Q96II8
  ENST ID: ENST00000425562
  CDS Start-End: 1-2334
atggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacagttcatcattcccctgcatattcttttcctgctgctatccagagaaatcagcctcagcgccctgaaagcttccttttccgagcaggtgtcagggcagaaaccaacaaaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcc

SEQ ID NO: 148387 - DNA, 2034 bp, Homo sapiens
  Payload ID: 9385
  Gene Symbol: LRCH3
  Gene Name: leucine-rich repeats and calponin homology (CH) domain containing 3
  ENST ID: ENST00000441090
  CDS Start-End: 16-1887
gttgtcggctgggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacagttcatcattcccctgcatattcttttcctgctgctatccagagaaatcagcctcagcgccctgaaagcttccttttccgagcaggtgtcagggcagaaaccaacaaaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttca

SEQ ID NO: 148388 - DNA, 3205 bp, Homo sapiens
  Payload ID: 9385
  Gene Symbol: LRCH3
  Gene Name: leucine-rich repeats and calponin homology (CH) domain containing 3
  ENST ID: ENST00000428136
  CDS Start-End: 1-544
caaaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaaggtattggccataattttaataattttagtttggtcagaatgttcagtttgaagatcacccacattccctagactgctcttctgagcccagtctatacgctgtatgtgctgcacacgagcagatgggctggagctggcctctcagggtgggcaccttccagattgtgtttgttatgtgtgactgaggttcactcccagcattctgtttaaatttggaatttatgtgatttctaacatattcaaaccttcttaatagtgaaacagtagcaggagaagtattagggcagcagtccctgttctgtgctcaaggcagtgaatattgtctagctctttcagaatgcgtagcacttagctgctagacgttaatgctggaaactataattgcggttagattctagtttcataagtggtgtttctgaatattcaggaaccttctgaactctgttaacaaaattgggataaaggatgaactcaagtgtgaagagagattgtgaggagcataatatccggtttagaattcagcctgagggaggagcataacatctgggtgtagaattcagcctgaggggctcactggtttggttttcttccatatgaaatgggacagctattttcacaggtcaaaagactgttcactattaatgctgaaacactcaacactgtgatgatgaaaacttcagttttctgtgtcagtaggtgcctttcagactttggggaattgggttggttatatttttaagatgtctcagagttgaaacacctgttaaaaaacacacacaggctctcatgtggtttaggggttgtaattgtacattctcttgagaacacacggcactccctctagtccagctgggaggtgagggtgccccagaaagcacaggcttctgagtgtgaacaccggccgcgcaggtcctagggcgctgctgagaggaagagaccagggaatcagccttggagaaagcacgtctcttccgacagcaaaacactgggcaggttcattttaagtatcatttatctagacttgcagttgcactcaaagtatttctacaaagttgctagtttttttagatcaaaagattacagttacctcattttatcaaaataagtattaaataaaaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacacca

SEQ ID NO: 148389 - DNA, 2299 bp, Homo sapiens
  Payload ID: 9385
  Gene Symbol: LRCH3
  Gene Name: leucine-rich repeats and calponin homology (CH) domain containing 3
  Uniprot ID: Q96II8
  ENST ID: ENST00000414675
  CDS Start-End: 16-2193
gttgtcggctgggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgagtgatgacagacctaatgctctattaagttcacctgcaacagaaacagttcatcattcccctgcatattcttttcctgctgctatccagagaaatcagcctcagcgccctgaaagcttccttttccgagcaggtgtcagggcagaaaccaacaaaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaa

SEQ ID NO: 148390 - DNA, 681 bp, Homo sapiens
  Payload ID: 9385
  Gene Symbol: LRCH3
  Gene Name: leucine-rich repeats and calponin homology (CH) domain containing 3
  ENST ID: ENST00000452660
  CDS Start-End: 1-681
tatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggacaatctttgttccccttccgacatccttcagctaaacctcagcgtt

SEQ ID NO: 148391 - DNA, 7394 bp, Homo sapiens
  Payload ID: 9385
  Gene Symbol: LRCH3
  Gene Name: leucine-rich repeats and calponin homology (CH) domain containing 3
  Uniprot ID: Q96II8
  ENST ID: ENST00000438796
  CDS Start-End: 45-2456
gcgcatgcgctgagctggcgggcccgagtgttgtcggctgggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcggacctgtcgcgaaatcgcctttcagaaattcctatagaagcatgtcactttgtttctctggaaaatctcaacttgtaccaaaattgtattcgttatattccagaggcaattttaaacctacaagctctaacattcttaaatattagtcggaaccaactgtcaacattgccggtacacttgtgtaatttgccattgaaagtcttaattgctagtaataacaaattggtgtcacttccagaagaaattggacaccttagacatttgatggaacttgatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttgtaagattgctccagatctgccggattatgataggagaccgttgggttttggctcctgccatgaagaactgtactcaagtcgcccttatggagcccttgattcaggcttcaatagtgtggacagtggtgataagagatggtcagggaatgaacctacagatgaattttcagatctgcctcttcgagtagcagagattactaaagaacaaagactacgaagagaaagccagtaccaagagaaccgcggcagtttggtagtaacaaacggcggagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgagggttcaccagtaaagccagtagccattagggagtttcaaaaaacagaagatatgagaagatatttacatcaaaacagggttccagctgagccatcttccctcctgtcactatcagcaagtcacaatcagctgtcacacacagacctggaacttcatcagagaagggagcagttagtagagcgcactcggagagaggctcagcttgctgccctgcagtatgaggaggagaaaataaggaccaagcagatccagagagatgctgtcctggactttgtcaaacaaaaagcatcacaaagtccacaaaaacagcacccgctcctagatggcgtagatggtgagtgccccttcccatccagaaggtctcagcacactgatgatagtgccttgtgcatgtcgctgtcagggttgaatcaagtgggctgtgctgctaccctgcctcattcttctgccttcacgcctcttaagagtgatgacagacctaatgctctattaagttcacctgcaacagaaacagttcatcattcccctgcatattcttttcctgctgctatccagagaaatcagcctcagcgccctgaaagcttccttttccgagcaggtgtcagggcagaaaccaacaaaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctgtgccattgtttttacctggtctcaagacaactggtctgctggtttctaaacttggttgttcattagactctcctggagtatttgttaaaatacagattcacattcagtagagctggggtaaggcctaggaatctgcattttcaacaaccattgcacatgtttttgtttttgttggagaaggagttctgctcagtcgcccaggctagagtgcagtggcataatctcagctcactgcaacctccgcctcccgggctcaagcgattctcctgcctcagcctcccgagtagctgggacaacaggtgcccgccaccatgcctggctaattttcttgtatttttagtagagatgggattttgtcatgttggccaggctggtctcaaactcctgacttcaagtgatccacctgcctcggcctcccaaaatgctgggattacaggcgtgagccactgtgcccggcctcccagagtgctgggatgacaggcgtgagcccccgcgcccggcctccgagagtgctgggattacaggcgtgagccactgtgcccggcctctgagggtgctgggattacaggcgtgagccactgcgcccggcgcccggcccattgcacgtgtttttcatgtagtggaaccactgttcaaagctagatatttgtatgtttgcgggggagggtaatggccccctgcatttttcacccacatttaaaatcaaaagctatattatgaggagttggactgttctgtcaaaggcaaaacaaaaataatatagaaggcctaggttttgcatagtcttcttttttttaagagttggggtcttgccgtattgcccaggctggtctgaaactcctgggctcaactgatcctcccgcctcagcctcccaaagtgctgggattactggagtgagccatcgggcctggcccagattttgcatagtaaaacagtgaaacagatagagttgtatttaaggtcagtattctaggcctcccttcaactgcagtcataccatcatagaagatagttctatgtcatcctgttatctggacattataataaacaacaagccctctatacacaggttccaaaccccgttatctagacattatcaacaacaagccctctctctatacagagtttccaaattctgaagctgatagcgcacttggtctcactgagcctccctccccgccctcctgctgctcctcagacatctgggcctgcagacacattgcagttacagcacatacacttctagctcggaaaagcctagtttcttgtatttctttcaggtaactgccagtttctgtggctgaatttaagcacttacagcatcttcctagctgggtgtggtggctcacacctgtaatctcagcactttgggaggctgaggcgggcagatcacctgaagttgggagtttgagaccagcctgaccaacatggagaaaccccgtctctactaaaaatacaaaattagctgggcgtggtggtgcatgcctgtaatcccagctactcgggaggctgaggcaggagaattgcttgaacccaggaggcggaggttgtggtgagccaagatcgtgccattgcaccccagcctgggcaacaaaagcgaaattccatctcaaaaaaagaaaacgcgccccatctcgctccaccacaagcgcctttatatactcaatgatgggtggaggaaaagggcccaagggctcacaccgcacaggagcctttactcaagtttcagctagttttccttcccctgcattttgaactccttttagttgttggtgatatcctttggtgttcactgcctttgtaaaacaagtaaataaagtaagcggaagatatctcttttgtttctgtagttgttaactgttctggattttctttacaatgcatccatttgggcataatgttatccctctttttatcaggtaaatgtagcatctaaaagtagctttggatcaaatcatgttgaatacctggtcaaagtaatgttttcttccttgttcttgcagagaaacaaattcatcagaacattaccacttgaccaggtttaaaattgtataacaggctgggcatggtggctcatgcctataatcccagcactttgggaggccgaggcaagaggatcacttgagcccaggagtttgagagcagcctgggcaacatagcaagaccctgtctcccaaaaattaaaaaaaaaaaaaaaaaaccaggtgtggtggcacctgcctgtactcccagctactcaggaggctggggtgggaggatcacttgagcctgggaggttgaggctacagtgagccatggctgcaccactgcactccagcctgggcaacagagtgagaccccatctctaaaaataaattgtacaacatctaacttcaatgcccaatcttatagaacaaaagtaaaatgtctttatgtaagaccccattatatttacagttcccaacagacccaccaactcttatatacccttatataacttgtttagaatttagccatgtgcatttttaaactgtgtttgtcaacattaagcctcagtacagtctccaaattatatgccaccagaaatgaaattcagcaaaggacaggattgtttttaacatacgcaagccagcctggccaacatggtgaaaccttgtctctactaaaaatacaaaaattagctgggcgtggtggtgggcacctgtaatcccagctacttgggtggctgaggcacaagaatcgcttcaacctggaagccgaaggttgcagtgggctgagattgtgccactgcactccagcctgggcaacagagcgagactctgtctcaaaaaaaaaaaaaaaaaaaaacccaccaaaccaaaaatatactatgcaaggaataattctagaagacattacataatgcaatacttgcaacatttgcaactaattttcccatagggataaatggaaatttcaacttatttcaaattttgcacatattatgaaaccttattaatgtatttttatcaaactaaatcagatttgtatttgaattgttaggaaaaaccatgtgcagttttggctgataattgaaggaaaaatatcaaatgctttgaattttttttctcttttttcaaaccctctgcagaggtaggaaggtatgaatttcttttttatgtcaagatgcaaaaacaaatcatgatgcttttgttgggagaatttttgtattcagtattttgtatgtacctttttttttttaaattggaaagcacaattcggtttaacatttagctttgcttgactccagtgtaagatgaagatgaccttgtcacagctcccctgacctgaagcagagcccttcccatcactgacagtgttgggggttgagagccccccagcagagcccttcccatcactgacagtgtgtcggcagctgagagctcccccagcagagcccttcccatcactgaacagtgttggcggctgagagccccccagcagagcccttcccatcactgacagtgttgggggctgagagccccccagcagagcccttcccatcactgaacagtgttggcggctgagagccccccagcagagcccttcccatcactgacagtgttgggggctgagagcccccctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaa

SEQ ID NO: 148392 - DNA, 977 bp, Homo sapiens
  Payload ID: 9385
  Gene Symbol: LRCH3
  Gene Name: leucine-rich repeats and calponin homology (CH) domain containing 3
  ENST ID: ENST00000433298
  CDS Start-End: 1-645
gctgtcctggactttgtcaaacaaaaagcatcacaaagtccacaaaaacagcacccgctcctagatggcgtagatggtgagtgccccttcccatccagaaggtctcagcacactgatgatagtgccttgtgcatgagtgatgacagacctaatgctctattaagttcacctgcaacagaaacaggtcatgcttcaccccttcctccatctgctgcacctaccactgattctacagattccataacaggacagaattcaagacagagagaagaagagctggaattaatagaccaactgcgtaaacatattgagtaccggttgaaagtgtctctaccttgtgatctcggagcagctctaactgacggtgttgttctttgccatttggccaatcatgtgcgacctcgatctgtcccaagcattcatgttccctcaccagctgtacctaaattaacaatggcgaaatgcaggcgaaatgtggaaaatttcctagaagcttgcagaaaaattggtgtacctcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgttcccatgattcctaacaggaatattttgcttcatttctccattttaggggaggttatttccatttccattgaatttttttacgaagacaccattggttttctcagatgaaacttctcttactgaaaacccagcacctaacttggctgtgttttcctggagagcaggcgtgtttcacgtgccagaaagcacatcttctgtgttaggcacaagcatgctg

SEQ ID NO: 148393 - DNA, 611 bp, Homo sapiens
  Payload ID: 9385
  Gene Symbol: LRCH3
  Gene Name: leucine-rich repeats and calponin homology (CH) domain containing 3
  ENST ID: ENST00000443727
  CDS Start-End: 54-332
ggtccggccgcgcatgcgctgagctggcgggcccgagtgttgtcggctgggaaatggcggccgcgggcttggtcgctgtggcagcggctgccgagtactctggcacggtagcgtcgggaggtaacctccctggtgttcactgcggcccaagctccggggcaggccctggttttggcccgggctcgtggagccgctctctcgatcgagccctggaggaggcggcggtcactggggtgctgagcctgagcggccggaaactgagggagtttccccggggagcggccaaccacgacctgacggacaccacccgggcgggatgtgagctgcaatgaaattcaaactataccttcccaaattggtaacctggaggccttgagagaccttaatgtaagaagaaatcacctagtacatttgcctgaagagctggcggagttgcctttgatacggttagacttctcatgcaataaaattaccacaatccctgtttgttatcggaacctcaggcacctacagacgatcaccctagataacaatccactacaatcacctcctgcacagatatgtataaaaggcaaagtccacatatttaaatacctgaacatacaagcttg

SEQ ID NO: 148394 - DNA, 2552 bp, Homo sapiens
  Payload ID: 9386
  Gene Symbol: LRCH4
  Gene Name: leucine-rich repeats and calponin homology (CH) domain containing 4
  Uniprot ID: O75427
  ENST ID: ENST00000310300
  CDS Start-End: 54-2105
gaaggagggacggccggtcccgtcagtcaggcagcgggagccgccgggagcggatggcggcggccgtagcggctccactcgccgccgggggtgaggaggcggcagccacgacctccgtgcccgggtctccaggtctgccggggagacgcagtgcagagcgggccctagaggaggccgtggccaccgggaccctgaacctgtctaaccggcgcttgaagcacttcccccggggcgcggcccgtagctacgacctgtcagacatcacccaggctgacctgtcccggaaccggtttcccgaggtgcccgaggcggcgtgccagctggtgtccctggagggcctgagcctctaccacaattgcctgagatgcctgaacccagccttggggaatctcacagccctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctgccctgcagaggatctatttccgggacatcggtacgatggtgggctggactcaggcttccacagcgttgatagtggcagcaagaggtggtctggaaatgagtcaacagatgaattttcagagctgtcattccggatctcagagctggcccgggagccccggggacccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtg

SEQ ID NO: 148395 - DNA, 774 bp, Homo sapiens
  Payload ID: 9386
  Gene Symbol: LRCH4
  Gene Name: leucine-rich repeats and calponin homology (CH) domain containing 4
  ENST ID: ENST00000485554
  CDS Start-End: 1-533
ctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaa

SEQ ID NO: 148396 - DNA, 2014 bp, Homo sapiens
  Payload ID: 9386
  Gene Symbol: LRCH4
  Gene Name: leucine-rich repeats and calponin homology (CH) domain containing 4
  ENST ID: ENST00000497245
  CDS Start-End: 1275-1970
aaatcttatctcctagctgggagtgctggccagctagagactgtccttccacgcctccacccgcaggatctgtccaaccatgcaccctccaccctggtgtctgtggatggtagggggtgggggacttaactgtgacagacctgtcccggaaccggtttcccgaggtgcccgaggcggcgtgccagctggtgtccctggagggcctgagcctctaccacaattgcctgagatgcctgaacccagccttggggaatctcacagccctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctgccctgcagaggatctatttccgggacatcggtacgatggtgggctggactcaggcttccacagcgttgatagtggcagcaagaggtggtctggaaatgagtcaacagatgaattttcagagctgtcattccggatctcagagctggcccgggagccccggggacccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctat

SEQ ID NO: 148397 - DNA, 2098 bp, Homo sapiens
  Payload ID: 9386
  Gene Symbol: LRCH4
  Gene Name: leucine-rich repeats and calponin homology (CH) domain containing 4
  ENST ID: ENST00000619071
  CDS Start-End: 1223-1651
ggggaatctcacagccctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctgccctgcagaggatctatttccgggacatcggtacgatggtgggctggactcaggcttccacagcgttgatagtggcagcaagaggtggtctggaaatgagtcaacagatgaattttcagagctgtcattccggatctcagagctggcccgggagccccggggacccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccaggctctggccagtggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtg

SEQ ID NO: 148398 - DNA, 2073 bp, Homo sapiens
  Payload ID: 9387
  Gene Symbol: LRRD1
  Gene Name: leucine-rich repeats and death domain containing 1
  Uniprot ID: A4D1F6
  ENST ID: ENST00000343318
  CDS Start-End: 556-906
ggagggcctcggagcaagacaatcccaccaagatggactcgggttgattaacgtgagtgaacctctgaggaccagaatccagactagtaattctccatcccggctgctcgttagatgcccggaccgacccccccagaccaattcaatcagaacattcggaggggcttgtaaaatctcccggggagattccggtacgaaagccaaagactcagacgcccgttctccacccgcctgcagcggccagcgcgggtccctcttagggaattgaatgcaggccccaggcctcctcctcgagtatcccagtgtgaccgatggccagctcacaaacgcgcagtgggtgcggccgcgccagggcgcagcggagcagagggcccggccgctttcggcctgggaaagaggagccacggcccggagaggcgtcagtgctgggctgcgcctgcggaggtcctcgcaattgctggactcaaccgcgcgcgccccctaccggtcctgcgaaggagccgcagccgccgcgggaggccacagctaacaagacttccaggagagctatctaatatgactcaacttaaagaacttgatatctcaaataatgcaatcagagagattccaagaaatataggagaattgagaaatttggttagtttacatgcatacaataatcaaataagttatcttccaccatctttgctatctttaaatgatctgcagcaactaaacctgagtggaaataatctgacagctctacctagtgctatctacaatattttttcactgaaggagataaattttgatgacaaccctttgctgagacctccagtggaaatctgtaaaggaaaacagttgtatactattgcacgctatctacagagggcagatgaaagagatggtctgcagcttcactcttgaagccagcaagaccaggaacccaccgggagaaaggaacaactccagacgcgccgccttaagagctgtaacactcactgcgaaggtctgcagcttcactcctgagccagcgagaccacgatcccaccagaaggaagaaactccgaacacatccgaacatcagaaggaacaaactccagaggcgccatcttaagagctgtaacactgaccgtgagggtcggcttcatacttgaagtcagtgagacgaagaacccaccaattccggacacaatttgacttaagccaggccattaacagtttcttttggatctttttgcagagctactatggaagatgcactctttctgcgggtaggttatgagtcttttagtcttggtatatcatgcacagtgtgtagtagtctgccgagagctggatgccaagagagagacagaaccttgtttatgttgtctgatcctcaatccccatacttctgcactttttacttttcacccacttaaggagtgtgacctgggtttccataactttgaatggaaagagacctaatacaagtggttaagaatattgtggagcccgggcagggtggctcatgcctgtaatcccagcactttgggaggctgagacgggcagatcacgaggtcaggagatcgagaccatcctggctaacacagtgaaaccctgtctctactaaaaatacaaaaaaatagctgggcatggtggcgggcgcctgtagttccagctactcgggaggctgaggcaggagaatggcgtgaactcaggaggcagagcttgcagtgagctaaggtggcaccactgcactccatcctgggcaacagagcgagactctgtctcaaaaaaaaaaaaatattgtggacatagtgcagtttttgttaccttaaaaaataattttctatgtgagaccatattaaataaatttattttgcaggttaaaatttaaagtgtatattttgttgccattttggaagtgcaacataacattggtttaacaactatacagcctgtgtctctaatccttccctattttaaaacttcttgcagtagggatgagaacctgtgggtttatattggcttaatgatggttgttgttaatgttttccactggaggcaaggtacttccatagaacattaaagtgtgaaggaccttggaaa

SEQ ID NO: 148399 - DNA, 407 bp, Homo sapiens
  Payload ID: 9387
  Gene Symbol: LRRD1
  Gene Name: leucine-rich repeats and death domain containing 1
  ENST ID: ENST00000437357
  CDS Start-End: 231-407
cggcccggagaggcgtcagtgctgggctgcgcctgcggaggtcctcgcaattgctggactcaaccgcgcgcgccccctaccggtcctgcgaaggagccgcagccgccgcgggaggccacaggtgaagcgaagggtgtgtcttacttcagcagccctattcaaaggaaaaaacatgaaaattaaaatcaagttacaattttgtattggcataaaacatatcagcaaataagatgtctgaaaaggagggtatgtcagaagtgctagaggatactattagtcaatttaggaaagaatctagatcacagtcaatgaaggagcctggctttattaaagaaacatcaaatttgataaacgaagcttctgattacctggaagggaaatcttctaaccagatttatgaaacacat

SEQ ID NO: 148400 - DNA, 2830 bp, Homo sapiens
  Payload ID: 9387
  Gene Symbol: LRRD1
  Gene Name: leucine-rich repeats and death domain containing 1
  Uniprot ID: A4D1F6
  ENST ID: ENST00000458448
  CDS Start-End: 202-2784
gagccacggcccggagaggcgtcagtgctgggctgcgcctgcggaggtcctcgcaattgctggactcaaccgcgcgcgccccctaccggtcctgcgaaggagccgcagccgccgcgggaggccacagattcaaaggaaaaaacatgaaaattaaaatcaagttacaattttgtattggcataaaacatatcagcaaataagatgtctgaaaaggagggtatgtcagaagtgctagaggatactattagtcaatttaggaaagaatctagatcacagtcaatgaaggagcctggctttattaaagaaacatcaaatttgataaacgaagcttctgattacctggaagggaaatcttctaaccagatttatgaaacacatcctagacagaatacattagagtcaacatcttcctctggaaggaagtctaagagaaatgaagaacaaaagaaaaatcttcaattttctgaaacaagcactagaacaggaacttcacagagtttatcatcactaactgggaggactgcagaatatcaggctttggttaacttcctatctcatgaaacagtaggagaagttagtccacaagtctctgaagaaaatcagaaacaacttggcctaggggcagataactttacagttaaccttgaggccaagggtttacaggaatttcctaaggacattttaaaaatcaaatatgtaaaatatctatatttagacaagaatcaaatcaaaacatttcaaggggcagactcaggtgatctgttaggacttgaaattctatccctgcaagaaaatggattatcatcacttccatctgaaattcagttacttcataatttaaggatattaaatgtcagtcataaccacatatcacatatacctaaagaaatatctcagcttgggaatatcagacaactctttttttataacaattacattgaaaattttccttctgacttagaatgtcttggaaacttggaaattttaagtttgggtaaaaataagttaagacatataccagatactctgcctagtttaaaaaccttgagggttctcaatttggaatataatcagttaacaacatttcctaaagctctctgcttccttccaaagttaatttcactagaccttactggaaacctaataagcagtttgccaaaagaaattagagagcttaaaaatttagaaacacttttaatggatcacaataagcttacctttctggctgtagaaatttttcagttactcaaaataaaagaactccaactggccgacaataaattggaagttatttcacacaaaattgagaatttcagggaacttaggattcttatacttgataaaaatttattgaaaaatataccagagaaaatatcttgctgtgcaatgttggaatgccttagtcttagtgataataaattaacagaactccctaagtacatccataagcttaacaatttaagaaaactccatgtaaacagaaataatatggtaaaaataactgactgtatctcacatcttaataacatatgcagtctagaattttcaggaaacataatcacagatgttcccattgaaataaaaaactgccaaaaaataattaaaattgaattgagttataacaaaataatgtattttccattgggactgtgtgctttagattctctttattatttgagtgttaatggaaattatatttcagaaatacctgtggatatatctttcagtaaacaactgcttcatttagaattgagtgaaaacaaactcctcatattttctgagcacttttgttctcttattaatcttaaatacctggatcttggtaaaaaccaaataaagaaaattccagcatcaatttctaatatgatatcactccacgtacttattttatgctgtaataaatttgaaactttccctagagaattgtgtactttagaaaatttgcaagtacttgatctttcggaaaaccaattacagaaaatctcttcagacatctgtaatttaaaaggaatccagaaattaaacttctcaagcaatcaatttatacattttcctattgaactgtgccaacttcaatcactggaacagctgaatataagtcagataaaagggagaaagctaacaagacttccaggagagctatctaatatgactcaacttaaagaacttgatatctcaaataatgcaatcagagagattccaagaaatataggagaattgagaaatttggttagtttacatgcatacaataatcaaataagttatcttccaccatctttgctatctttaaatgatctgcagcaactaaacctgagtggaaataatctgacagctctacctagtgctatctacaatattttttcactgaaggagataaattttgatgacaaccctttgctgagacctccagtggaaatctgtaaaggaaaacagttgtatactattgcacgctatctacagagggcagatgaaagagatgagaaaattttagagaagatattcaagatagttgccaacaacatcactgaaaccaattttgaatttttatgtcaaaaactaaacctggcaaactcagaaactgatatgcctacaaagagcactgtttcattaagtgagagagcccaccaagcacttgttatatggaaaacacaaagtaacaagttatcactaactgctgctgctttaagagatcaactaattcgagcactaactatgataggagcatatgaaattatggacaaaataacagctttaaatctttttacgcgtgcaattaaattctaaccagtggatcaataataaaaactgaaaacttttgatgcacttataa

SEQ ID NO: 148401 - DNA, 2661 bp, Homo sapiens
  Payload ID: 9387
  Gene Symbol: LRRD1
  Gene Name: leucine-rich repeats and death domain containing 1
  Uniprot ID: A4D1F6
  ENST ID: ENST00000430130
  CDS Start-End: 75-2657
attcaaaggaaaaaacatgaaaattaaaatcaagttacaattttgtattggcataaaacatatcagcaaataagatgtctgaaaaggagggtatgtcagaagtgctagaggatactattagtcaatttaggaaagaatctagatcacagtcaatgaaggagcctggctttattaaagaaacatcaaatttgataaacgaagcttctgattacctggaagggaaatcttctaaccagatttatgaaacacatcctagacagaatacattagagtcaacatcttcctctggaaggaagtctaagagaaatgaagaacaaaagaaaaatcttcaattttctgaaacaagcactagaacaggaacttcacagagtttatcatcactaactgggaggactgcagaatatcaggctttggttaacttcctatctcatgaaacagtaggagaagttagtccacaagtctctgaagaaaatcagaaacaacttggcctaggggcagataactttacagttaaccttgaggccaagggtttacaggaatttcctaaggacattttaaaaatcaaatatgtaaaatatctatatttagacaagaatcaaatcaaaacatttcaaggggcagactcaggtgatctgttaggacttgaaattctatccctgcaagaaaatggattatcatcacttccatctgaaattcagttacttcataatttaaggatattaaatgtcagtcataaccacatatcacatatacctaaagaaatatctcagcttgggaatatcagacaactctttttttataacaattacattgaaaattttccttctgacttagaatgtcttggaaacttggaaattttaagtttgggtaaaaataagttaagacatataccagatactctgcctagtttaaaaaccttgagggttctcaatttggaatataatcagttaacaacatttcctaaagctctctgcttccttccaaagttaatttcactagaccttactggaaacctaataagcagtttgccaaaagaaattagagagcttaaaaatttagaaacacttttaatggatcacaataagcttacctttctggctgtagaaatttttcagttactcaaaataaaagaactccaactggccgacaataaattggaagttatttcacacaaaattgagaatttcagggaacttaggattcttatacttgataaaaatttattgaaaaatataccagagaaaatatcttgctgtgcaatgttggaatgccttagtcttagtgataataaattaacagaactccctaagtacatccataagcttaacaatttaagaaaactccatgtaaacagaaataatatggtaaaaataactgactgtatctcacatcttaataacatatgcagtctagaattttcaggaaacataatcacagatgttcccattgaaataaaaaactgccaaaaaataattaaaattgaattgagttataacaaaataatgtattttccattgggactgtgtgctttagattctctttattatttgagtgttaatggaaattatatttcagaaatacctgtggatatatctttcagtaaacaactgcttcatttagaattgagtgaaaacaaactcctcatattttctgagcacttttgttctcttattaatcttaaatacctggatcttggtaaaaaccaaataaagaaaattccagcatcaatttctaatatgatatcactccacgtacttattttatgctgtaataaatttgaaactttccctagagaattgtgtactttagaaaatttgcaagtacttgatctttcggaaaaccaattacagaaaatctcttcagacatctgtaatttaaaaggaatccagaaattaaacttctcaagcaatcaatttatacattttcctattgaactgtgccaacttcaatcactggaacagctgaatataagtcagataaaagggagaaagctaacaagacttccaggagagctatctaatatgactcaacttaaagaacttgatatctcaaataatgcaatcagagagattccaagaaatataggagaattgagaaatttggttagtttacatgcatacaataatcaaataagttatcttccaccatctttgctatctttaaatgatctgcagcaactaaacctgagtggaaataatctgacagctctacctagtgctatctacaatattttttcactgaaggagataaattttgatgacaaccctttgctgagacctccagtggaaatctgtaaaggaaaacagttgtatactattgcacgctatctacagagggcagatgaaagagatgagaaaattttagagaagatattcaagatagttgccaacaacatcactgaaaccaattttgaatttttatgtcaaaaactaaacctggcaaactcagaaactgatatgcctacaaagagcactgtttcattaagtgagagagcccaccaagcacttgttatatggaaaacacaaagtaacaagttatcactaactgctgctgctttaagagatcaactaattcgagcactaactatgataggagcatatgaaattatggacaaaataacagctttaaatctttttacgcgtgcaattaaattctaaccag

SEQ ID NO: 148402 - DNA, 3163 bp, Homo sapiens
  Payload ID: 9388
  Gene Symbol: LRGUK
  Gene Name: leucine-rich repeats and guanylate kinase domain containing
  Uniprot ID: Q96M69
  ENST ID: ENST00000285928
  CDS Start-End: 70-2547
acaggccccagaatcctccgcggttccccttgcctggggtcagtctcctaggcaaccccgctaaacaagatggcgacctccgagagggctctcctgaggaccagagctgcctctctcctgagaggcttgggcagatcccgaactggagcccgatcgttacagtttcgcgcagaaaaagagcgtcagccttgctggtcttttcccatggggcagaagacgaaaggcagctctaacatagcctcctcctacctgctccagcagctcatgcaccgctatcaggagctggactcggacggagatgaggaccagggcgagggcgaggcgggatccgaggagtcctcagagtccgaaatgctgaatttggaggaggaatttgatggggtcctgagagaggaggctgtggccaaagcactccatcacttggggcgctcaggctctgggactgagcaagtctacctcaatctaactttatcaggttgtaatttaattgatgttagcattctctgtggatatgttcatctacagaagttggatctttcagcgaataaaattgaagatttatcttgtgtgagttgtatgccttatctcctagaacttaatgcttctcaaaataatttgactacgttcttcaatttcaagccacccaaaaacctcaagaaggcggatttttcccacaaccaaatttctgaaatttgtgatttgtcagcgtatcatgctctcactaaactaattttggatggcaatgagatagaagaaatcagtggactagagatgtgcaacaacctaattcaccttagtttggccaacaataagatcacgacaattaatggcttaaacaagttaccaatcaaaatactttgtctgagcaataaccagattgagatgatcacaggtttggaggatctgaaagccctgcagaacctggatctgtcccacaatcagataagcagcctccaaggcttagagaatcatgacctcctggaagtgatcaacctggaggataataagattgctgagctgagagaaatagaatacattaaaaatttacccatccttcgagttctcaatcttctagaaaatccaattcaggaaaagtctgaatattggttcttcgtaatttttatgcttctgcgattaacagaattagatcagaagaagattaaagtggaagaaaaggtttcagcagtgaataaatatgatcctccccctgaagtggttgcagctcaagaccacctgacccatgttgtcaacagcgtgatgcagccgcagaggatctttgacagcactcttcccagcctggatgccccttatcccatgctgatactagctggtcctgaagcttgtgggaaacgagagcttgcccatcgcctctgcagacagtttagcacttacttcagatatggggcctgtcataccacaagaccaccttactttggagaaggggatcgagttgattatcattttatctctcaagacgtttttgatgaaatggtgaacatggggaaattcattctaacatttagttatggtaatcacaagtatggattaaatagggacaccgtagaaggtatcgcaagagatggtttggcaagctgtattcatatggaaatagaaggtgtaagaagtttgaaatattcctattttgagcctcgttatatcctggtggtgcccatgaacaaggaaaaatatgagggatatttgcggagaaaaggattattcagtcgtgcagaaattgaatttgctgtctccagagtggacctttatattaaaattaatcagaattttccgggatattttgatgaggtaatcaatgcagatgatctggatgttgcctaccaaaaactgagtcagctcattagagaataccttggattgactgaggaacctgccaagagtttggctacaactgcagatgttaagacatcccacctgaaacctgaagcgcatcctacaaagtatatttcttcgaatatgggtgatttcctgcattctacagacagaaactacctcattaaattttgggccaaactttcagccaaaaaaacaccagcggaaagagattctatacacagacagcacgaggcagcccggcaagctctaatgggaaggatacgccctgatcacacactcctatttcaaaggggtccagtaccagcacctctcaccagtggtctacactattatacaactttagaagaactctggaaaagttttgatctttgtgaagactattttaaacctccatttggaccatatcctgaaaagagtgggaaggattccttggtttccatgaaatgttcattgtttcggttctgtccgtggtcaaaagaattgcctttccagcctccggaggggagcatttcttcacacctaggatcaggagccagtgacagtgagaccgaagagacccggaaagcactacctatacaatcattttcacatgaaaaagagtctcaccaacacagacaacactcggtcccagtcatcagtcgcccaggttccaacgtcaaacccaccctccctccaatccctcagggccgcaggtagactagcacttgatgtctgatcctaacatggaaaacctgctctgctgatgtcgaattccttgccttacctggccatgggtccagctgtttctcactcaacccattacccacggaagaatgttctacctgccttaattctatcagccagtttctcttgtgattctttggctggtgtcttttagttttttaattaaaaaattgtttcttaaatgatttttaaagatgtgagtttttttaatgtgagttattcttagcttttaaaaatgtcatttcatttttttttctatagctataaataattttttccacctgctccctgctcggaaatatcagatggaaaaatctcccaagatctctgcaccgtgatatgcagagtggctttctgatatatccaactgggattgtgctcttaaaatttcaatatgtccatttacaacattcctgtatgctctagaggattgatttattttgctctgattatgaaaggattgcagagttccatttaacttgtcgccaacatgatatcgactgcatctctcaaaaggaattaatgtaattttggggggttcttgacttactttagcaacacgaaagaataaagagcaacagttgattct

SEQ ID NO: 148403 - DNA, 5273 bp, Homo sapiens
  Payload ID: 9389
  Gene Symbol: LRIG1
  Gene Name: leucine-rich repeats and immunoglobulin-like domains 1
  Uniprot ID: Q96JA1
  ENST ID: ENST00000273261
  CDS Start-End: 526-3807
gctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgcgggcgggccggccggcccggatgggcgcggggtttgcggcccccgccgggtgctccggagcggcccgggcaccgggggcacgctgagtgccggagccgcggccgcagagagaacttggggcgggggccatgccccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctgactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtca

SEQ ID NO: 148404 - DNA, 5283 bp, Homo sapiens
  Payload ID: 9389
  Gene Symbol: LRIG1
  Gene Name: leucine-rich repeats and immunoglobulin-like domains 1
  Uniprot ID: Q96JA1
  ENST ID: ENST00000383703
  CDS Start-End: 605-3817
gattgttcggctgcgaggtcggcgggactcttgctgcgcggaggagccgtgcggaacccgaggctgcgcgcgcgcgcgcgctctctggccgcggcgtggggacagcgaggcgcactggggcctcccagcgcggggccggccgcgccgtccagcccgaggtctacggctttgcgctccgagcccagaggaagatgcctgccggcaccgagctcgggctgcggggctgaacgcctgtcttccaggcgcagcggcagcactgccctcggccggtgtcggtagcggcactcggcgtgccccgggcggacgaagagcgcaggctgggtacaccttgcccgaatcggcggagttcgcagctagcgcgggcgggccggccggcccggatgggcgcggggtttgcggcccccgccgggtgctccggagcggcccgggcaccgggggcacgctgagtgccggagccgcggccgcagagagaacttggggcgggggccatgccccggtgcggagtctagagccgagcggagcgccccgcgggcccgcccgcgtctgcggccgttcgggtcctcacagtccccgcgcccggagttcgcagcgcgctccagacaagatggcgcggccggtccggggagggctcggggccccgcgccgctcgccttgccttctccttctctggctgcttttgcttcggctggagccggtgaccgccgcggccggcccgcgggcgccctgcgcggccgcctgcacttgcgctggggactcgctggactgcggtgggcgcgggctggctgcgttgcccggggacctgccctcctggacgcggagcctaaacctgagttacaacaaactctctgagattgaccctgctggttttgaggacttgccgaacctacaggaagtgtacctcaataataatgagttgacagcggtaccatccctgggcgctgcttcatcacatgtcgtctctctctttctgcagcacaacaagattcgcagcgtggaggggagccagctgaaggcctacctttccttagaagtgttagatctgagtttgaacaacatcacggaagtgcggaacacctgctttccacacggaccgcctataaaggagctcaacctggcaggcaatcggattggcaccctggagttgggagcatttgatggtctgtcacggtcgctgctaactcttcgcctgagcaaaaacaggatcacccagcttcctgtaagagcattcaagctacccaggctgacacaactggacctcaatcggaacaggattcggctgatagagggcctcaccttccaggggctcaacagcttggaggtgctgaagcttcagcgaaacaacatcagcaaactgacagatggggccttctggggactgtccaagatgcatgtgctgcacctggagtacaacagcctggtagaagtgaacagcggctcgctctacggcctcacggccctgcatcagctccacctcagcaacaattccatcgctcgcattcaccgcaagggctggagcttctgccagaagctgcatgagttggtcctgtccttcaacaacctgacacggctggacgaggagagcctggccgagctgagcagcctgagtgtcctgcgtctcagccacaattccatcagccacattgcggagggtgccttcaagggactcaggagcctgcgagtcttggatctggaccataacgagatttcgggcacaatagaggacacgagcggcgccttctcagggctcgacagcctcagcaagctccttttattagagccatcccagtctgctggctgcagctccccgtcccagccccatatgtctgctgggggaaggactctgtttggaaacaagatcaagtctgtggctaagagagcattctcggggctggaaggcctggagcacctgaaccttggagggaatgcgatcagatctgtccagtttgatgcctttgtgaagatgaagaatcttaaagagctccatatcagcagcgacagcttcctgtgtgactgccagctgaagtggctgcccccgtggctaattggcaggatgctgcaggcctttgtgacagccacctgtgcccacccagaatcactgaagggtcagagcattttctctgtgccaccagagagtttcgtgtgcgatgacttcctgaagccacagatcatcacccagccagaaaccaccatggctatggtgggcaaggacatccggtttacatgctcagcagccagcagcagcagctcccccatgacctttgcctggaagaaagacaatgaagtcctgaccaatgcagacatggagaactttgtccacgtccacgcgcaggacggggaagtgatggagtacaccaccatcctgcacctccgtcaggtcactttcgggcacgagggccgctaccaatgtgtcatcaccaaccactttggctccacctattcacataaggccaggctcaccgtgaatgtgttgccatcattcaccaaaacgccccacgacataaccatccggaccaccaccatggcccgcctcgaatgtgctgccacaggtcacccaaaccctcagattgcctggcagaaggatggaggcacggatttccccgctgcccagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacttgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtca

SEQ ID NO: 148405 - DNA, 11555 bp, Homo sapiens
  Payload ID: 9390
  Gene Symbol: LRIG2
  Gene Name: leucine-rich repeats and immunoglobulin-like domains 2
  Uniprot ID: O94898
  ENST ID: ENST00000361127
  CDS Start-End: 199-3396
gtccgtcaggccgtgtgtcccaggccgtcgaccccgctgtcgcgctgcgtctgctccttgcatgcctttagatggtacagccttcagccggggcttcgggagacagtgcagccaccgagcatctctgctgagcttctccgccgatcctccttttctagcaggcagctcttctaggccacgtccaggtcgagggggaaaatggcgccggcgcccctaggcgtcccggaggagcagttgctggggtgtcgatctagagtgctttctcggttactcttcattgcccagaccgctctcctcctgttgcccgccgccggagcaggtctctgccccgcgccctgctcctgccgcattcctctcctggactgcagtcgcaggaaattgcccgcaccgagctggagggcgctgtcgggcttgctgccccccgacaccgctatcctggatttcagtcataatcggttgtctaactggaacatcagcttggaatcacaaacattacaggaagtgaaaatgaattacaatgaactaacagaaatcccgtattttggagaacctacatctaatattactctactttcattagtccataatataatcccagaaataaatgcacaggcactccagttttaccctgctctggagagtttagacctcagctcaaatataatatcagaaatcaagacatcttcatttcctcgcatgcagcttaaatacctgaatttaagtaataacagaataaccaccttggaggctggttgcttcgataatttatcaagttccttattagtggtaaagttaaaccgtaaccgaatgagcatgattccacctaagatcttcaagctgcctcacctccaattcttggaacttaaaagaaacagaattaaaattgtggaaggtcttacattccaagggcttgactccttaagatctttgaaaatgcagcggaatggaattagcaaacttaaggatggagcattttttggcttgaataacatggaagaactagaactggaacacaacaaccttacacgagtaaacaaggggtggttgtatggcttgcgaatgttacagcagctctatgtgagccagaatgctattgaaagaatcagccctgatgcatgggagttctgccaaagactatccgaacttgatttgtcctataaccagctgacccgcctggatgaatctgcctttgtgggtctgagcttattggagagattgaatttaggagacaacagagtcactcatattgctgatggtgtatttagatttctttccaatcttcagacattagacttaagaaacaatgaaatttcatgggccatagaagatgctagtgaagcctttgctggactcacaagtctcactaaactaatcttacaaggaaaccagattaagtcaattacaaagaaagcattcattggtcttgaatcccttgagcatctagatttgaacaataatgctataatgtctatccaagaaaatgctttttctcagactcatttaaaagaactgattctgaacacaagcagtttgctctgtgactgccatttgaagtggctacttcaatggttggttgataataactttcaacattctgtgaatgtaagctgtgcacaccctgaatggctagcagggcaaagcatcctgaatgtggatctgaaagattttgtctgtgatgattttctcaagccacagataaggacacatcctgaaaccataattgctctaagaggcatgaatgtgactctgacgtgcactgcagtgagcagcagtgattcacccatgtccactgtgtggcgcaaagacagtgaaatcctgtatgacgtggatactgagaattttgttcgttattggcagcaagctggagaagctctggaatatactagtatcttacatcttttcaatgtgaatttcacagatgaaggaaaatatcagtgtattgttactaatcactttggttctaattattctcagaaagccaaactgactgtaaatgagatgccatcttttctgaaaacgccaatggatctgactattcgcactggtgccatggccagattagaatgtgctgcagagggacaccctgcacctcagatttcctggcagaaagatggtggtactgactttcctgcggctcgagaaagacgcatgcacgtcatgcccgaggatgacgtcttctttattgccaatgtgaaaatagaagatatgggaatctatagctgcatggcacaaaatacagcaggaggtctctcagcaaatgcttccctaacagtgttagagacaccctcatttattagacccctggaggataagacagtaacacgaggtgaaactgcggtgttacagtgcatagctggagggagtcctgcccctcgtctcaactggactaaagatgatgggcctttgctggtgacagaacgacatttctttgctgcagccaatcagcttctcatcattgtagatgccgggctagaagatgctgggaaatatacctgcattatgtctaacacccttgggacagaacgtggccacatttacctaaatgtcatttcatcccccaattgtgactcttcccagagtagcattgggcatgaagatgatggctggaccacagttggcattgtcatcattgttgtggtctgctgtgttgttggcacttctttgatctgggtcattgttatttaccacatgagaaggaaaaatgaagactatagtatcacaaacacagaggagctcaatctgcctgcagacattcccagctacttgtcttcccaaggaacgctgtctgagccacaggaaggctacagcaactctgaggcaggcagtcatcagcaacttatgcctcctgccaatggatatatacacaaaggcactgacggtggcactggtacccgggtgatttgctcagattgttatgacaatgccaacatctactccaggacccgagaatactgtccatacacctatattgctgaggaggacgttcttgatcagacactgtccagcctcatggtccaaatgcctaaagagacatatttagtacatcctccccaggatactactgccctagagagcctgataccgtcagccaacagagagccatctgcctttcccaccaaccatgagaggataagtgagaagaaacttccctccacacagatgagcggtgaaacattgcagcggcccgtgtggaacataaacagagaactaggcctgcctcatcctcctttttcccagcagccagtccatgagtcaccacaacttcatcaaaatgagggcctggcagggagagagccagactgttctgcttcttccatgtcctgccacaggttacaggatcatgcttttgattttagtaggactcggaacattcaagatggtagtgagggcacatgaaactcacttcaggatgaaatctgggcagagacttattaattaattttgcatttactacctcagagctcagaagaaactccgaagtcagcatttgctttactctttctttatgattgcatctgaccgcaccaaggtgggccatgcgttgtttggtcttatacctgatgaagaaatggcaacagctgacagaaatgggtacagctcatcaaaaatgtgcagcaccggcagagggaagatacggggcaaatgtgcttcctgatgcttccatggggatgtgccctggtgtgcatctgcttgtcaggaagagtcacattgctgcttaacatgctggattgccctagtcttcagaatggtcctgagaaaacatcactacttcgatgttctactttgctttccaaggagcaaaaataactttggagccttctgggaagtgtgcctgggattcttcagtggtttcaggcagatagttgagactggggctttgatattcaaggtctttggcaagaatcccaggcttgaccaactggtaccaggtcaaagatttttgtattcttgtgaatttttttttttgtccctattgcccagggatgtcattgtaaatatatgtgcatttataaataatttttgtattcattgaccatatgtgttggctgcaatgtaaatatttttgatatgccaaaattatatgtaatatccagttataatattgacaagtagcttctcagatcacagattttaaataactcaatttagtgagatctaaaaattttatttaaagtataaaaactgtggctcacacctgtaatcccagcattttgagaggctaaggtgggaggattgcttgaggccaggaatttgagaccaggctgggcaacatggtgagaccctgtgtctgcaaaaaaataaattaaaaaaataggtggacattgtggcatgctgctgtagtcctagctacttgggaggctgaggtgggagggtcacttgagcccgggaaatcaaggctgcagtgagctgtgtgaagccactgcatcccagcctgggtgacagagtgaggccctggctcaaaagtaaaataaataaataaaaagttttaaaaacttacttgttaagaagtgtatctatagaggcagctacttagtgattgtatacacataaacacagtcttggtgtaattaaccgccttcttcatgcctagaggttcatacttctggtcatttgccatctgtttaaaagtgctaggtgatactccctttctaacataaaaagcttgttctttcagagcctggcagtcctgtcacagctgtatgcacctagaggaaaacttgtttggaaattcctttcatttcctccccctctccctccttccctctttttttttactgaaacagaaattgattgaggaaggttcagtcattccttcaggaaccaatgagttagatcgggttgttactttatgtataatgaacgcttcaaaaactggaggctgatttaaagattgcagaacttgagtcagactcataagcagtactgtgacatgaattggagccagaacagttgctgatatcagaaccatctctttcattctgtgactttgctcttgccatgttctgactggggtgagccgctaggatacaaatcactatcactgtccatatttgagtctgcaaatcttgtcattgtctgctttaatgctctttgagttgcaacaggtgtattatttaaatgagtatttgaaattctgtgaacaggaattcttttggtagtgaaataggtgctcacacctgcttgctcagaatgtgaaaatattatttctgagttctctttgttcactttctaaagtgactgttgtttggtgttggagatgttaactgggttctattaggtgtgctatatcttggcaaatattccccatgatgaactcttcctactatcacaatcaggactatgactggatttctcagtctcagtgccccagattcaccatttctgattgtgtctggagaacgttttcctggaaaggcattccatgttccaaaagctacaaaaacatgccactttgcaactatgggtcagttatttgctctctcaatgtctcatgttgctgagttctagaaaatctctgtctcatttaccaggggtcattcaaaagtctgagatgtatattatcatgaaatatttgtgaaatttctcaccatgaatttggagggaacctacttttatttctcgctctggttctccattggtctgggctcctgcttctcagtcttctctgacctctggtaagtggaactttcattaatacttctgtcgcactttgtacctgacctaggtggccttgcaaatgttgactcagattgtggattttccactttcctctgttttccctattttctcccctgggaaatcttgcagatgatgcatattcattttctgtattcagccttccattattaaggataaaattgatccctacattgaatctgaaattaccactatatggattactctggctcactgctgtccaagcttggttttctctttgcttacttcctgtcatattttcagtttgcccaaaagaggtaagccactttattacagacccattactagtgctagacgtcatccacctctgttttcacctgattcttgtggggaatcctctttaatttgttgtaaccttctcagcaactcttctgtacttcacctatagtgcctagcaaattgttatcactcataagcctgtaatcttcatcactcaggttatttgcaagtagaaagcttctggaaccatttgtccatccgacttctgcactgggccacatccatcttcttcattgtcagaatctgagttttctgtcttgaagaacagctggaaagttgtctggctgttatgacacagtattgaaataccagactgagtttcagttgtttctagttgtgttcactttgtgctttctctgaatgggaatatcttctttcagcaaagttcttcattgaccaggaaaccaaagattgcttcttttccaagtttgttttgtttttaatcttttaccaatgtgcagtatatcttaagaagggaagagtgctcttgggagtagaagaacatgcaaacattcttttttctttattattatttgagatggagtccctctcggtcacccaggctggagcgcagtggcatgatcttggcttactgcaacctccgcctcccaggttcaagcaattctcttgcctcagcctcccaagtagctgggattacaggcacaccaccatttccagctttttttttttttttttttttgatatttttagtagagatggggtttcaccatgttggccaggctggtcttgaactcctgacctcaggtgatctgcttgccttggcctcccaaagtgctgggattacaggcatgagccacttgcctggccccaaaattcttatactgtaaagccttgtagtggtccttatttttttttttttgagacggagtctcgctctgtcacccagactggagtgcagtggcacaatctcggctcactgcaacctctgcctcccgagttcaagcccttcttctgcctcagcctcccaagtacctgggattacaggcatgcaccaccatgcccggctaattttatttgtatttttagtagagacggggtttctccatgttggtcaggctggcctcgaactcctgacctcaggtgatccacccgcctcggcctcctagagtgctgggattacaggcgtgagccaccgagcccggccggtccttattttatacaagtgattaagccaaaaattttcttgaatttctgataccaaagagctttaggtaaataacttcacactctaatgcaatgtaattctttctttgtgctttcagatttccttacacttcctgtccagttctctcttctaaatccaatattactcactagataatttcagccacttaaataaaaatatctatttttaagtcctggttcaagggttccaaactcacataatttctcaactttttgccagaaagttgagcatttattcatacttattttcaatcctaagtgttctcccatgggcagcagcacttcttgagctgtttagtactgccacacctttttatgtctttactatgtcagcctctgatcattttcactttgaacttcctaaagatcacaatttcctatcccttcaatctgcgatccctcttcttcctttcttactagattatggtgtagtttgtactagactgactcattaagaccttgtacgcttcctgagtctgcttattactggctttgtaatcaagggtgagtctttttacttctctaggctagattttctcatttatgaaatgaggacatttttctagatgctgtaaagccctttccagctgtaacattctatgaatctgtaattccctcgaggagctaaggaggattatgctactttaataaaaagctgctttggtgacatttgttcgagtagaacaagagtgatgctgctcattctgacttgagccagatgtatttcctttatagcaggagtaatggtctaagaaatactcattaggagaaaaaaattctgcttctaaacagtattagtaaacaaagaatcttgactcagttgaaaaaccacccattgctctctagagcagaatgtctgaatgctggttttatagcacactagaatatcagaatgagttgacaggtataccacaactaatttgtaactagtttgtgactcacctttctaatgtattcgaagttatccctataattatattactctcgctcaaattctgatagatttcctgaatggaataggtggaattagggctaggctgccagagactgtgccaatgagcatcacccgtcatgtgtgagagagcagaagatagcctgtgagccagtgctctagaaaacatcatgtaggaggccggtcacggtggctcacgcctgtaatcccagcactttgggaggccgaggtggatggatcaagagatcgagaccatcctggccaacatggtgaaattccacctctactaaaaatacaaaaattagctgggcgtggtggtgcgcgcctgtagtcctagctgctcgggaggctaaggcaggagaatcacttgaacctgggaggcagaggttgcagtgagccgagattgcaccactgcactccagcctggtgacagagtgagactccgtctcaaaaaaaaaaaaaaaaaaacccgtgtaggagtactgcctctctgctctagcagtggtccttctactgacagtgctgtcagagtctggtctcctaaagagccaggtcattttccattgtgtcaactcagatggttgagatgtccttagatattcctagcttgcctaaataactagtcagcaatctatttaaatgtgaagagcctatctctggtctttaaataaacacacacacacacacacacccctaggaaaaggaattcctgaaacttttcattattgcatatgtttctgatcaagcaatatgttaaccctctaagtaggattagtgtcccatgagtatttcttccagcagaatcatgtctgcctaatgctaatcaggaatgttgcaaactgaaatgctcctttccccactgccccctaatgaccactttcaggaggaatacatacattctcttgatttgtttgtcccctttcaggctgattctccacttccacctggaagaaaagacagtattccttgaactccatgacctactggtacaggatctacacttatgccattggctttctgtcactccgcaacttgtacttttttttttgagacagggtttcaccctgtcagccaggctggagtgcaatggtgtgaacgtggctcactgtcgtcactgcagccttgatatctcaagcccaagtgatcctcccacctcaaccacctgagtagctgtgccaccacacccggctaatttttgtattttttgtagagatggagtttcaccttgttgcccaggctgatcacaaactcctgggctcaagcaatctccccacttaggcctcccaaagtgcagggattataggcatgagccaccgcaccccgcagtactttccctcgtatacaagctactctcctgaaaaaaatagcaggaacccattccaatgtccaagctcccctaaagtgccaactcagaataactttcatgtttaaaaacagctgtcttcacattgcccattgtgaggttgtaaaaggaagttaagatgtcaagcaatttagattctgttacccatttccctatgaaaagagatgtgttaaaagtctttaactacttaaagggtcatcatgaaaaataagaattctattccagaagacagagttatacacagggaggtgtattatatacttgctaataaatttttgtgtaggctctttagtaaatttatctgataatggaataatcagcctttttggtggaaaggtacatacagaagctaaatcatcatctgttaatagtgtttaagagatttcttcattgagatggaatatgggcaagatgacctttaaggtctttttcacttttatcattggaaatccccagaagcaatctgatagtcttaaaactttgtcctttctaagtcctttgtattcattttagagctcttcaggaaactagagaattttggactttggttgacaaaagcggtctgacctgtgttcgtagctgggaacatgaaacacaaaattctgggtttaatcttctgaagaaatctataagtagttactggcataaatggtattactatactaacaaatttaaaagcctataatgtattaaaactcttttttactcgattacttttatttttttaagacacagtctcgcttattgccccggctggagtgcagtggcacggtctcagctcactgcaatctccgcctcccaggttcaagcgattctcctgcctcagcctcccaagtagctggaattaattacagacgcccaccaccatgcccggctaatttttgtatttttagtagagatggggtttcaccgtgttgcctaggctggtcttgaactcctgacctcaagtgatcaacccaccttggcctcccaaagtgctgggattacaggcatgagccactgtgcccagccctcttgataatttttattcttgtttcttcttatctgtgggactccaattagaatggggttgagattgtggcattcagttttataccaatattttacccaagtgtgtcatggccttttttaatcattttaatatccccagaaatgctagaagtgtaaaggaataacagaggtaaatttgctgtcattttatgccacatcctcttttcttactttgcttcttgatacagattatagaggtaattgtgaagacagttgaaccttagaagattgagctaagattctttttttggcaacctgcaagtaatgtttcatttttctattacgtgatctctttgcccatacagttggcagatgttttttccccctttttctaccttaaacttttttgtttggagtacagtctaaaccaacatcagttagccttgattttctttcttttttggacaattgtctggttcattgacaaaagtaacaagtttggaactaagagatatgttacaagctgcacttaacaccacctgaaaacccaagaatcatctgaaggttttgtcagtagtaaggtaggttttgtgtgtgtgtgtgtgtgtgtgtgtgtgtgtgtgtgtgtgtgaagatggaatagggtgaaggtgaagaaacagcttgacttgtgcctgttttcagataaaggagtaaagtgatctacaaactgtaactatcttgaaagagaaattgatcatcagatggtcgagtactcttggaatgtctctttgctgtttactgtggcctctttacaatggtgagacttatttctaccctctactttccactattatttttttcccctattggataatactagtctgagcagccctaatactagatgtacctaaacagagatacaagccaagtcattgttcagtgtagtcatttcttagtatctgtttatattttgtcacacatcagaatgtatattttatagagcatgtgtttgtctacttgtttgtctactataatatgtctttaataaagctaaaaacattctga

SEQ ID NO: 148406 - DNA, 4070 bp, Homo sapiens
  Payload ID: 9391
  Gene Symbol: LRIG3
  Gene Name: leucine-rich repeats and immunoglobulin-like domains 3
  Uniprot ID: Q6UXM1
  ENST ID: ENST00000320743
  CDS Start-End: 288-3647
ggcgaaaaagtttcttttgcagacaagaaggggcttcggcgagccgacgctgctcaagctgcaactctgttgcagttggcagttcttttcggtttccctcctgctgtttgggggcatgaaagggcttcgccgccgggagtaaaagaaggaattgaccgggcagcgcgagggaggagcgcgcacgcgaccgcgagggcgggcgtgcaccctcggctggaagtttgtgccgggccccgagcgcgcgccggctgggagcttcgggtagagacctaggccgctggaccgcgatgagcgcgccgagcctccgtgcgcgcgccgcggggttggggctgctgctgtgcgcggtgctggggcgcgctggccggtcagacagcggcggtcgcggggaactcgggcagccctctggggtagccgccgagcgcccatgccccactacctgccgctgcctcggggacctgctggactgcagtcgtaagcggctagcgcgtcttcccgagccactcccgtcctgggtcgctcggctggacttaagtcacaacagattatctttcatcaaggcaagttccatgagccaccttcaaagccttcgagaagtgaaactgaacaacaatgaattggagaccattccaaatctgggaccagtctcggcaaatattacacttctctccttggctggaaacaggattgttgaaatactccctgaacatctgaaagagtttcagtcccttgaaactttggaccttagcagcaacaatatttcagagctccaaactgcatttccagccctacagctcaaatatctgtatctcaacagcaaccgagtcacatcaatggaacctgggtattttgacaatttggccaacacactccttgtgttaaagctgaacaggaaccgaatctcagctatcccacccaagatgtttaaactgccccaactgcaacatctcgaattgaaccgaaacaagattaaaaatgtagatggactgacattccaaggccttggtgctctgaagtctctgaaaatgcaaagaaatggagtaacgaaacttatggatggagctttttgggggctgagcaacatggaaattttgcagctggaccataacaacctaacagagattaccaaaggctggctttacggcttgctgatgctgcaggaacttcatctcagccaaaatgccatcaacaggatcagccctgatgcctgggagttctgccagaagctcagtgagctggacctaactttcaatcacttatcaaggttagatgattcaagcttccttggcctaagcttactaaatacactgcacattgggaacaacagagtcagctacattgctgattgtgccttccgggggctttccagtttaaagactttggatctgaagaacaatgaaatttcctggactattgaagacatgaatggtgctttctctgggcttgacaaactgaggcgactgatactccaaggaaatcggatccgttctattactaaaaaagccttcactggtttggatgcattggagcatctagacctgagtgacaacgcaatcatgtctttacaaggcaatgcattttcacaaatgaagaaactgcaacaattgcatttaaatacatcaagccttttgtgcgattgccagctaaaatggctcccacagtgggtggcggaaaacaactttcagagctttgtaaatgccagttgtgcccatcctcagctgctaaaaggaagaagcatttttgctgttagcccagatggctttgtgtgtgatgattttcccaaaccccagatcacggttcagccagaaacacagtcggcaataaaaggttccaatttgagtttcatctgctcagctgccagcagcagtgattccccaatgacttttgcttggaaaaaagacaatgaactactgcatgatgctgaaatggaaaattatgcacacctccgggcccaaggtggcgaggtgatggagtataccaccatccttcggctgcgcgaggtggaatttgccagtgaggggaaatatcagtgtgtcatctccaatcactttggttcatcctactctgtcaaagccaagcttacagtaaatatgcttccctcattcaccaagacccccatggatctcaccatccgagctggggccatggcacgcttggagtgtgctgctgtggggcacccagccccccagatagcctggcagaaggatgggggcacagacttcccagctgcacgggagagacgcatgcatgtgatgcccgaggatgacgtgttctttatcgtggatgtgaagatagaggacattggggtatacagctgcacagctcagaacagtgcaggaagtatttcagcaaatgcaactctgactgtcctagaaacaccatcatttttgcggccactgttggaccgaactgtaaccaagggagaaacagccgtcctacagtgcattgctggaggaagccctccccctaaactgaactggaccaaagatgatagcccattggtggtaaccgagaggcacttttttgcagcaggcaatcagcttctgattattgtggactcagatgtcagtgatgctgggaaatacacatgtgagatgtctaacacccttggcactgagagaggaaacgtgcgcctcagtgtgatccccactccaacctgcgactcccctcagatgacagccccatcgttagacgatgacggatgggccactgtgggtgtcgtgatcatagccgtggtttgctgtgtggtgggcacgtcactcgtgtgggtggtcatcatataccacacaaggcggaggaatgaagattgcagcattaccaacacagatgagaccaacttgccagcagatattcctagttatttgtcatctcagggaacgttagctgacaggcaggatgggtacgtgtcttcagaaagtggaagccaccaccagtttgtcacatcttcaggtgctggatttttcttaccacaacatgacagtagtgggacctgccatattgacaatagcagtgaagctgatgtggaagctgccacagatctgttcctttgtccgtttttgggatccacaggccctatgtatttgaagggaaatgtgtatggctcagatccttttgaaacatatcatacaggttgcagtcctgacccaagaacagttttaatggaccactatgagcccagttacataaagaaaaaggagtgctacccatgttctcatccttcagaagaatcctgcgaacggagcttcagtaatatatcgtggccttcacatgtgaggaagctacttaacactagttactctcacaatgaaggacctggaatgaaaaatctgtgtctaaacaagtcctctttagattttagtgcaaatccagagccagcgtcggttgcctcgagtaattctttcatgggtacctttggaaaagctctcaggagacctcacctagatgcctattcaagctttggacagccatcagattgtcagccaagagccttttatttgaaagctcattcttccccagacttggactctgggtcagaggaagatgggaaagaaaggacagattttcaggaagaaaatcacatttgtacctttaaacagactttagaaaactacaggactccaaattttcagtcttatgacttggacacatagactgaatgagaccaaaggaaaagcttaacatactacctcaagtgaacttttatttaaaagagagagaatcttatgttttttaaatggagttatgaattttaaaaggataaaaatgctttatttatacagatgaaccaaaattacaaaaagttatgaaaatttttatactgggaatgatgctcatataagaatacctttttaaactattttttaactttgttttatgcaaaaaagtatcttacgtaaattaatgatataaatcatgattattttatgtatttttataatgccagatttctttttatggaaaatgagttactaaagcattttaaataatacctgccttgtaccattttttaaatagaagttacttcattatattttgcacattatatttaataaaatgtgtcaatttgatgccaa

SEQ ID NO: 148407 - DNA, 3667 bp, Homo sapiens
  Payload ID: 9391
  Gene Symbol: LRIG3
  Gene Name: leucine-rich repeats and immunoglobulin-like domains 3
  Uniprot ID: Q6UXM1
  ENST ID: ENST00000379141
  CDS Start-End: 65-3244
gtaactgaagtcaggcttttcatttgggaagccccctcaacagaattcggtcattctccaagttatggtggacgtacttctgttgttctccctctgcttgctttttcacattagcagaccggacttaagtcacaacagattatctttcatcaaggcaagttccatgagccaccttcaaagccttcgagaagtgaaactgaacaacaatgaattggagaccattccaaatctgggaccagtctcggcaaatattacacttctctccttggctggaaacaggattgttgaaatactccctgaacatctgaaagagtttcagtcccttgaaactttggaccttagcagcaacaatatttcagagctccaaactgcatttccagccctacagctcaaatatctgtatctcaacagcaaccgagtcacatcaatggaacctgggtattttgacaatttggccaacacactccttgtgttaaagctgaacaggaaccgaatctcagctatcccacccaagatgtttaaactgccccaactgcaacatctcgaattgaaccgaaacaagattaaaaatgtagatggactgacattccaaggccttggtgctctgaagtctctgaaaatgcaaagaaatggagtaacgaaacttatggatggagctttttgggggctgagcaacatggaaattttgcagctggaccataacaacctaacagagattaccaaaggctggctttacggcttgctgatgctgcaggaacttcatctcagccaaaatgccatcaacaggatcagccctgatgcctgggagttctgccagaagctcagtgagctggacctaactttcaatcacttatcaaggttagatgattcaagcttccttggcctaagcttactaaatacactgcacattgggaacaacagagtcagctacattgctgattgtgccttccgggggctttccagtttaaagactttggatctgaagaacaatgaaatttcctggactattgaagacatgaatggtgctttctctgggcttgacaaactgaggcgactgatactccaaggaaatcggatccgttctattactaaaaaagccttcactggtttggatgcattggagcatctagacctgagtgacaacgcaatcatgtctttacaaggcaatgcattttcacaaatgaagaaactgcaacaattgcatttaaatacatcaagccttttgtgcgattgccagctaaaatggctcccacagtgggtggcggaaaacaactttcagagctttgtaaatgccagttgtgcccatcctcagctgctaaaaggaagaagcatttttgctgttagcccagatggctttgtgtgtgatgattttcccaaaccccagatcacggttcagccagaaacacagtcggcaataaaaggttccaatttgagtttcatctgctcagctgccagcagcagtgattccccaatgacttttgcttggaaaaaagacaatgaactactgcatgatgctgaaatggaaaattatgcacacctccgggcccaaggtggcgaggtgatggagtataccaccatccttcggctgcgcgaggtggaatttgccagtgaggggaaatatcagtgtgtcatctccaatcactttggttcatcctactctgtcaaagccaagcttacagtaaatatgcttccctcattcaccaagacccccatggatctcaccatccgagctggggccatggcacgcttggagtgtgctgctgtggggcacccagccccccagatagcctggcagaaggatgggggcacagacttcccagctgcacgggagagacgcatgcatgtgatgcccgaggatgacgtgttctttatcgtggatgtgaagatagaggacattggggtatacagctgcacagctcagaacagtgcaggaagtatttcagcaaatgcaactctgactgtcctagaaacaccatcatttttgcggccactgttggaccgaactgtaaccaagggagaaacagccgtcctacagtgcattgctggaggaagccctccccctaaactgaactggaccaaagatgatagcccattggtggtaaccgagaggcacttttttgcagcaggcaatcagcttctgattattgtggactcagatgtcagtgatgctgggaaatacacatgtgagatgtctaacacccttggcactgagagaggaaacgtgcgcctcagtgtgatccccactccaacctgcgactcccctcagatgacagccccatcgttagacgatgacggatgggccactgtgggtgtcgtgatcatagccgtggtttgctgtgtggtgggcacgtcactcgtgtgggtggtcatcatataccacacaaggcggaggaatgaagattgcagcattaccaacacagatgagaccaacttgccagcagatattcctagttatttgtcatctcagggaacgttagctgacaggcaggatgggtacgtgtcttcagaaagtggaagccaccaccagtttgtcacatcttcaggtgctggatttttcttaccacaacatgacagtagtgggacctgccatattgacaatagcagtgaagctgatgtggaagctgccacagatctgttcctttgtccgtttttgggatccacaggccctatgtatttgaagggaaatgtgtatggctcagatccttttgaaacatatcatacaggttgcagtcctgacccaagaacagttttaatggaccactatgagcccagttacataaagaaaaaggagtgctacccatgttctcatccttcagaagaatcctgcgaacggagcttcagtaatatatcgtggccttcacatgtgaggaagctacttaacactagttactctcacaatgaaggacctggaatgaaaaatctgtgtctaaacaagtcctctttagattttagtgcaaatccagagccagcgtcggttgcctcgagtaattctttcatgggtacctttggaaaagctctcaggagacctcacctagatgcctattcaagctttggacagccatcagattgtcagccaagagccttttatttgaaagctcattcttccccagacttggactctgggtcagaggaagatgggaaagaaaggacagattttcaggaagaaaatcacatttgtacctttaaacagactttagaaaactacaggactccaaattttcagtcttatgacttggacacatagactgaatgagaccaaaggaaaagcttaacatactacctcaagtgaacttttatttaaaagagagagaatcttatgttttttaaatggagttatgaattttaaaaggataaaaatgctttatttatacagatgaaccaaaattacaaaaagttatgaaaatttttatactgggaatgatgctcatataagaatacctttttaaactattttttaactttgttttatgcaaaaaagtatcttacgtaaattaatgatataaatcatgattattttatgtatttttataatgccagatttctttttatggaaaatgagttactaaagcattttaaataatacctgccttgtaccattttttaaatagaagttacttcattatattttgcacattatatttaataaaatgtgtcaatttgatgccaa

SEQ ID NO: 148408 - DNA, 3693 bp, Homo sapiens
  Payload ID: 9391
  Gene Symbol: LRIG3
  Gene Name: leucine-rich repeats and immunoglobulin-like domains 3
  ENST ID: ENST00000433272
  CDS Start-End: 200-2071
tcggtttccctcctgctgtttgggggcatgaaagggcttcgccgccgggagtaaaagaaggaattgaccgggcagcgcgagggaggagcgcgcacgcgaccgcgagggcgggcgtgcaccctcggctggaagtttgtgccgggccccgagcgcgcgccggctgggagcttcgggtagagacctaggccgctggaccgcgatgagcgcgccgagcctccgtgcgcgcgccgcggggttggggctgctgctgtgcgcggtgctggggcgcgctggccggtcagacagcggcggtcgcggggaactcgggcagccctctggggtagccgccgagcgcccatgccccactacctgccgctgcctcggggacctgctggactgcagtcgtaagcggctagcgcgtcttcccgagccactcccgtcctgggtcgctcggctggacttaagtcacaacagattatctttcatcaaggcaagttccatgagccaccttcaaagccttcgagaagtgaaactgaacaacaatgaattggagaccattccaaatctgggaccagtctcggcaaatattacacttctctccttggctggaaacaggattgttgaaatactccctgaacatctgaaagagtttcagtcccttgaaactttggaccttagcagcaacaatatttcagagctccaaactgcatttccagccctacagctcaaatatctgtatctcaacagcaaccgagtcacatcaatggaacctgggtattttgacaatttggccaacacactccttgtgttaaagctgaacaggaaccgaatctcagctatcccacccaagatgtttaaactgccccaactgcaacatctcgaattgaaccgaaacaagattaaaaatgtagatggactgacattccaaggccttggtgctctgaagtctctgaaaatgcaaagaaatggagtaacgaaacttatggatggagctttttgggggctgagcaacatggaaattttgcagctggaccataacaacctaacagagattaccaaaggctggctttacggcttgctgatgctgcaggaacttcatctcagccaaaatgccatcaacaggatcagccctgatgcctgggagttctgccagaagctcagtgagctggacctaactttcaatcacttatcaaggttagatgattcaagcttccttggcctaagcttactaaatacactgcacattgggaacaacagagtcagctacattgctgattgtgccttccgggggctttccagtttaaagactttggatctgaagaacaatgaaatttcctggactattgaagacatgaatggtgctttctctgggcttgacaaactgaggcgactgatactccaaggaaatcggatccgttctattactaaaaaagccttcactggtttggatgcattggagcatctagacctgagtgacaacgcaatcatgtctttacaaggcaatgcattttcacaaatgaagaaactgcaacaattgcatttaaatacatcaagccttttgtgcgattgccagctaaaatggctcccacagtgggtggcggaaaacaactttcagagctttgtaaatgccagttgtgcccatcctcagctgctaaaaggaagaagcatttttgctgttagcccagatggctttgtgtgtgatgattttcccaaaccccagatcacggttcagccagaaacacagtcggcaataaaaggttccaatttgagtttcatctgctcagctgccagcagcagtgattccccaatgacttttgcttggaaaaaagacaatgaactactgcatgatgctgaaatggaaaattatgcacacctccgggcccaaggtggcgaggtgatggagtataccaccatccttcggctgcgcgaggtggaatttgccagtgaggggaaatatcagtgtgtcatctccaatcactttggttcatcctactctgtcaaagccaagcttacagtaaatattccccacctgactcttcctttccctacctttcattccacaaaattaagattcttggttatttgtatctaaacctgcaattatgttgaagacgacaccgtactcagtgtgtgcttccctcattcaccaagacccccatggatctcaccatccgagctggggccatggcacgcttggagtgtgctgctgtggggcacccagccccccagatagcctggcagaaggatgggggcacagacttcccagctgcacgggagagacgcatgcatgtgatgcccgaggatgacgtgttctttatcgtggatgtgaagatagaggacattggggtatacagctgcacagctcagaacagtgcaggaagtatttcagcaaatgcaactctgactgtcctagaaacaccatcatttttgcggccactgttggaccgaactgtaaccaagggagaaacagccgtcctacagtgcattgctggaggaagccctccccctaaactgaactggaccaaagatgatagcccattggtggtaaccgagaggcacttttttgcagcaggcaatcagcttctgattattgtggactcagatgtcagtgatgctgggaaatacacatgtgagatgtctaacacccttggcactgagagaggaaacgtgcgcctcagtgtgatccccactccaacctgcgactcccctcagatgacagccccatcgttagacgatgacggatgggccactgtgggtgtcgtgatcatagccgtggtttgctgtgtggtgggcacgtcactcgtgtgggtggtcatcatataccacacaaggcggaggaatgaagattgcagcattaccaacacagatgagaccaacttgccagcagatattcctagttatttgtcatctcagggaacgttagctgacaggcaggatgggtacgtgtcttcagaaagtggaagccaccaccagtttgtcacatcttcaggtgctggatttttcttaccacaacatgacagtagtgggacctgccatattgacaatagcagtgaagctgatgtggaagctgccacagatctgttcctttgtccgtttttgggatccacaggccctatgtatttgaagggaaatgtgtatggctcagatccttttgaaacatatcatacaggttgcagtcctgacccaagaacagttttaatggaccactatgagcccagttacataaagaaaaaggagtgctacccatgttctcatccttcagaagaatcctgcgaacggagcttcagtaatatatcgtggccttcacatgtgaggaagctacttaacactagttactctcacaatgaaggacctggaatgaaaaatctgtgtctaaacaagtcctctttagattttagtgcaaatccagagccagcgtcggttgcctcgagtaattctttcatgggtacctttggaaaagctctcaggagacctcacctagatgcctattcaagctttggacagccatcagattgtcagccaagagccttttatttgaaagctcattcttccccagacttggactctgggtcagaggaagatgggaaagaaaggacagattttcaggaagaaaatcacatttgtacctttaaacagactttagaaaactacaggactccaaattttcagtcttatgacttggacacatagactgaatgagaccaaaggaaaagc

SEQ ID NO: 148409 - DNA, 759 bp, Homo sapiens
  Payload ID: 9391
  Gene Symbol: LRIG3
  Gene Name: leucine-rich repeats and immunoglobulin-like domains 3
  ENST ID: ENST00000552267
  CDS Start-End: 291-759
aaaaaaacatctcttaaaacatttgtgggcttaaagtatttgaatctgccagtctccctaaactaattttgtccttggagcttgtatttttgagtttggcattttggttgccatctagtttgtggacagaatagaccaattatttctcctgctctcactggtgttcatagagatacttcataagcccagttagcactattagtgatttttagaaatgacttataattttatttttgttttcttatagggacttaagtcacaacagattatctttcatcaaggcaagttccatgagccaccttcaaagccttcgagaagtgaaactgaacaacaatgaattggagaccattccaaatctgggaccagtctcggcaaatattacacttctctccttggctggaaacaggattgttgaaatactccctgaacatctgaaagagtttcagtcccttgaaactttggaccttagcagcaacaatatttcagagctccaaactgcatttccagccctacagctcaaatatctgtatctcaacagcaaccgagtcacatcaatggaacctgggtattttgacaatttggccaacacactccttgtgttaaagctgaacaggaaccgaatctcagctatcccacccaagatgtttaaactgccccaactgcaacatctcgaattgaaccgaaacaagattaaaaatgtagatggactgacattccaaggccttggtgctctgaagtctctgaaaatgcaaagaaatg

SEQ ID NO: 148410 - DNA, 923 bp, Homo sapiens
  Payload ID: 9391
  Gene Symbol: LRIG3
  Gene Name: leucine-rich repeats and immunoglobulin-like domains 3
  ENST ID: ENST00000550825
  CDS Start-End: 1-490
gacctgccatattgacaatagcagtgaagctgatgtggaagctgccacagatctgttcctttgtccgtttttgggatccacaggccctatgtatttgaagggaaatgtgtatggctcagatccttttgaaacatatcatacaggttgcagtcctgacccaagaacagttttaatggaccactatgagcccagttacataaagaaaaaggagtgctacccatgttctcatccttcagaagaatcctgcgaacggagcttcagtaatatatcgtggccttcacatgtgaggaagctacttaacactagttactctcacaatgaaggacctggaatgaaaaatctgtgtctaaacaagtcctctttagattttagtgcaaatccagagccagcgtcggttgcctcgagtaattctttcatgggtaagtttattaagttatcaggtacctcgtctgaggatccatactccaagttgtgtgtgagagagcaatgacagccttgaatgtcaaactggtaaaaaatggtttcttgaatgaggctgccatgacatccgactagttagtgtaaatgcctccaaaagcaaagtcagaggtgggattttacttgatgatgtgtttaatctataactaagcctcaggagctttctgggtagcactgtgtgtggcatctactccaagacaagggtttggggaggacttaggagctcagcttgtcagccatgtggaaaaagtggttttgggctcccacggcctttggggtggagttgtgtgctctgcatgattgtggtttggtatgtctggtggcttccaactgaacccgcagtcgaagggtggaaaacaacatcctacctagcaacaactgctagtctgacaagctggactacctttggccaagaaaaccagccttaaggtccaagtcggtggtgt

SEQ ID NO: 148411 - DNA, 555 bp, Homo sapiens
  Payload ID: 9392
  Gene Symbol: LRRIQ1
  Gene Name: leucine-rich repeats and IQ motif containing 1
  ENST ID: ENST00000393212
  CDS Start-End: 62-555
gtgtagcggctatgggcgctgtcttacaacaaagccaaggaatctcgctgctgagggaataatggacgatgatgatgcaaagctcaaagcagaaatagaagctgaattggataaactcagcatttcctccttggaaaaagaagacattgagagtgatgcaaaatcagaaacccagagtgatgatagtgatacagattcagttgaattaccagaatcagttcttcactgtattaacatcataaagaacaggagtaaagctgttgaagagctcattcttcaggacctggaagatactgatattttaagctgtagttatggagcagtttctaataatcatatgcatttaagaacaggactatcaactgaatatgaagaaagttcagagcaattaattaagatattatctgaaatagaaaaagaagaatttatgagaagtaaaaccgattgtgccactcctgattttgttcctgagcctagtcctcatgacttgcctatggatgaacatgttttaccagatgatgctgatataaattttggatactgtgaagtggaaga

SEQ ID NO: 148412 - DNA, 5394 bp, Homo sapiens
  Payload ID: 9392
  Gene Symbol: LRRIQ1
  Gene Name: leucine-rich repeats and IQ motif containing 1
  Uniprot ID: Q96JM4
  ENST ID: ENST00000393217
  CDS Start-End: 62-5230
gtcttacaacaaagccaaggaatctcgctgctgagggttctgtgctttattatgaagaataatggacgatgatgatgcaaagctcaaagcagaaatagaagctgaattggataaactcagcatttcctccttggaaaaagaagacattgagagtgatgcaaaatcagaaacccagagtgatgatagtgatacagattcagttgaattaccagaatcagttcttcactgtattaacatcataaagaacaggagtaaagctgttgaagagctcattcttcaggacctggaagatactgatattttaagctgtagttatggagcagtttctaataatcatatgcatttaagaacaggactatcaactgaatatgaagaaagttcagagcaattaattaagatattatctgaaatagaaaaagaagaatttatgagaagtaaaaccgattgtgccactcctgattttgttcctgagcctagtcctcatgacttgcctatggatgaacatgttttaccagatgatgctgatataaattttggatactgtgaagtggaagaaaaatgtagacagtcttttgaggcttggcaagagaaacagaaggaattagaagataaagagaaacaaactctcaaagctcagagggatagagaagaaaaacaatttcaagaagaagaagaaaagcgacattgctggatgaaacaatttaaagttgaaaagaagaaattagagaacattcagaagcaagaacaggacaagatgaatgatgaactctataaagaagagaaaatttggaaagagaaatttaaacagcatgaggagtatattagaaacttgcatttacaaatggaagaagaaagaacaagatttaaagaccaacaagaaaaagaaaaaaattctttgttaaaacagcagaataatgcagctgttaaaattcaagctaaatataaagcatttgttgcctatcaaaaatatggcccaattattaaagagcaaattgaaagtaagaaaaggaaagcacaagagtggaaggaaaaggaagcaaaaatacgacaaaaggaggaagaaaatcgaaaaagattagaggaggaacaaaggataaaagaagagagaaaaaagcaaaaggaagaggaaaggaaaaggagagaaaaagaatatgaagaaaaaaagaatattgtgaaacaggaaagagagcaactaataagcaaggaaaaaataatattaagagaagatgcaagccaacagctaataataagtagtgcattaaagaagagcggatataataacaaacatttaagtcttgaagatatttcaaatgataagggtgatatagccaaaaatctagtggatgaaaattcaaagaagcaggaagatgttctcctttggctagttgaggaatcaaatatgaaagaaaatgtagatagacagactatattaaaagaatcaatacaagtaaagttaaaagaatctatatcaagccaaacaattctggcagattttaaaatggaagaaaaaaatgaaaacctagcaaaaaaacgatgttcagaagaattggtcaagcaagaaagaaaatatgaaaatacagataacaaaactgaattgggaaactctgatctaaaaggaaatctgaaagaacagtttccattgcaagaattaaagtctgatgcacaaaaagaagaaaaaatcatgaaacatgtcataaatgagaatacaggacaaaaaacccagataatattaggacataaccaagaaatcagtgaggtgaaaaccaatgaagagcagaaaataatcaaagataatcagcagaaaaagatacaaaaagtagaaaaagaagagatacaagaacagaatggattattatataaagataaggatactttagttatttcagtgaaacaaagatcactctcactaacatcagaaaattccaaagatgtaagagaaaacgtaatattacaagaaaaagaaatttattcaaaatccaaagaaattgaggagaacccaaaagacaatgcttggaatagtggcattgtgatttttaacacaactgataccatgataaatatagaaggcaaaagaaatgaccaagattatgtgttaggtagacatgctccttgtgagggcttgagtaactataatgcagaaagctccatggtatctaaagaagtcaactctcttaaatctgagattagaaatatttcagaaaaatgccatgaaaatgcacctgaacctgatagcatgacctgctgtgtatcagagtcaacccttctatattctattgaagaaaggagactagcctggataaaatcatttaaaccttggcttgaaattttcaagcaaaatcaacaaaagaaaattgttagaagaaagagacctgtgaaatgcccagccaacatgacacccgctttggataaactggaaattcttcgatgtggcccttgggatactttacagcaggttacaacagttacatttcaagatttgccaggctgtgttctctccacactggcagagtgtacaaatcttcagtttctatcccttcgacgctgtggattaacttctttgcacagcctgagtaattgtaaaaaacttaagtacattgatgcacaggaaaaccatattgaggctattgagtgtgaaaatttggaaaatctctgtgttgttcttcttaataaaaatcaactgacttctcttcatggtttggatggctgtactaatattcagtgtcttgaactttcatataataaaattactcgaattggatattccttctttctggaagaaaaacttgttgacaatgcagggttctgccatcacttgggcacctccacttcttacttatccctggcacaagtctggattccaactggattatgttggtcctggatacctattacctcacttacaaaaaattcagattgtaatttccttatctcccacttatactggaattgtggtttagaatctttgaaaaatcttcaacaactaattttggaccacaatcagttaattaatacaaaaggtctttgtgatacacctaccattgtatacctagattgctcccataatcatcttactgatgtagagggcgttgaaaattgtggattgctccaaatattgaagttacagggaaattatctgagtgagcttccatccttggagaatcttgttttactaagagaattgcacttggatgataacagcatttcaactgtggaagcattttcttcatactggctgcctttactacaaaatattactatctctcaaaacagcttgactaaaatcgtaccactttttcattttgtttcattggaaaagctagatgtcagccacaattgtctttctgatcttaaaagtgccataaaatggtttgatgcatgctattctctccatgaattgtctcttactggaaacccacttcttcaagaaacaaactggagggattctctacttaaagtgttgcctgctctgagaatcctcaatggcaatatactaaactctaattcagaaagccgcactgaagaacacaatcaactgggatcagcaggtttcctggcactttgtcagtctcagattcgagaattcaacttgctaattgaaaattatataactggaaaaggagatgtatttaccttggatactgcagaaaatctctgtcattattttaagaaattgatgatacttagtactgaataccgacatgcacacgaacgaggggatgtaactatcaccaagaaagatgaatcagaagcccagaaaaatcatttggcccctacaaacagtgacagcactctgcaaaatggagtcttctactcttgtgcacgtgaaggtgagccagactcaccagatattcctgagaaatggatggactctgtctccagccactccccattaagcaaatccgccacatgtgaaaatatggaaggaagacatcaggaaatattagtatgtcagaagagagaagacagcaaggcaagcagtattcccaccataagaatcccatttaaggaagtagtaatgacaaattctttgctgaggaatcaccaaaatattgagcctagtgaaaaaattatggcagctgtggtaatccagtcatactggcgtggttacctcatgcgcagacagactcatttctccacaaggctacatactgctgcaacagaaggcctgccaaattcttccatcaagaatcagactattttaaagaaaggaaaaagagaaaatattgtgaatatccgaaaacagagggagaaggctgctattcttattcaggcagtttggaagggctttattttgcgaaagaaactgacaacagctctagaggctattaagaatgaagaatccgatgaagaatacagagaaatagatttagaggattttatatttgatgaagctgccttagaagaagaatggctagcattagattccacccgcttcccttcacaaacactgcttctttcaaaccagctgcattggccaaagattcctggaaacttaaaatgggatgatacttcatttaatttaccaagtaatccagctcaagcatggttatgtaatgacaaagaaaatttgtcttcttcagaacacacacaatttaatagcagatcagaaaataaaacttcttcctggacacctgaatcaaagaccagtagaaagagtttgctaaaatctgaaaaagaaaaaaaaatttcagaagaatggggctttaaggatatttctactgctcagcaaatgttgaagagggcacagaaaatgaaatcgaagaaactaaagaaaaaaatagattccactgtgcgtctagccttattcaaaaacaatgaaaataaagtgtctcttccaaaatcaccaaagatggtacagcccagaagagatggttactttgaaggtatagaagaagaccctatccacaaagataccactgcaaatgaaaaattagaacggaatagagaatatacataccaatggcttcacacacaggttggggttcatgaaacgactagttccagaaatatgaaatgcaatcactttttgcctgagttagatccagatgtacttaatggtggaagagttcagcttgtggcaagacttgtaagcagagaagacacggatttagaccttttttccatgaccaatggaagtgctttgtctgtgaacagagaaaaaaaaaatcaggcacacagacactcagcaggatcttcaagtaagttgtggtttccttcaaaattaatttagaaatcacaaacgaattgatggaacctaatgccaacaagcattctttttcagatagggggtaggatgccagcaacctgaactgcccaaaaatgtgtatttaaattttttctttctttaaatatcctcttttgatataaacaaaattaaattatttctaaaattaa

SEQ ID NO: 148413 - DNA, 559 bp, Homo sapiens
  Payload ID: 9392
  Gene Symbol: LRRIQ1
  Gene Name: leucine-rich repeats and IQ motif containing 1
  ENST ID: ENST00000526363
  CDS Start-End: 1-323
ccttattcaaaaacaatgaaaataaagtgtctcttccaaaatcaccaaagatggtacagcccagaagagatggttactttgaaggtatagaagaagaccctatccacaaagataccactgcaaatgaaaaattagaacggaatagagaatatacataccaatggcttcacacacaggttggggttcatgaaacgactagttccagaaatatgaaatgcaatcactttttgcctgagttagatccagatgtacttaatggtggaagagttcagcttgtggtaagaaatgtgcttaaagttacagaaaaatgttgtagacactagtgctcaaataaatggcactttaagatatgtttataattaaactatgaaaatatcacaactgtatctatttgggataatatcaaaatatcatgtgttaaaataataacatgttttcttgacttgtaatacaatttaaaatgtgacattgcttaaaaatgttaattttatgtgacagatgtaaaaatattagcatcctacaactttaaaataaaattactgtggatggaaaattgaaa

SEQ ID NO: 148414 - DNA, 432 bp, Homo sapiens
  Payload ID: 9392
  Gene Symbol: LRRIQ1
  Gene Name: leucine-rich repeats and IQ motif containing 1
  ENST ID: ENST00000533414
  CDS Start-End: 1-432
atgaagaaagttcagagcaattaattaagatattatctgaaatagaaaaagaagaatttatgagaagtaaaaccgattgtgccactcctgattttgttcctgagcctagtcctcatgacttgcctatggatgaacatgttttaccagatgatgctgatataaattttggatactgtgaagtggaagaaaaatgtagacagtcttttgaggcttggcaagagaaacagaaggaattagaagataaagagaaacaaactctcaaagctcagagggatagagaagaaaaacaatttcaagaagaagaagaaaagcgacattgctggatgaaacaatttaaagttgaaaagaagaaattagagaacattcagaaggagtatattagaaacttgcatttacaaatggaagaagaaagaacaagatttaaagaccaac

SEQ ID NO: 148415 - DNA, 2849 bp, Homo sapiens
  Payload ID: 9393
  Gene Symbol: LRRIQ3
  Gene Name: leucine-rich repeats and IQ motif containing 3
  Uniprot ID: A6PVS8
  ENST ID: ENST00000354431
  CDS Start-End: 193-2067
gtcgcccacgtaaccacgcccccggagcgccttggctggcgcccggaaaaccatgatgtggagaacttggatgttgtcttgtttctctagcaacggtctcaggagcagatggccgcccagcgatttgtctgactgtgttggggctgggccacttgtctccaactcataagggcttgcagcccagttgacccgatgtttcatggaacagtcacagaagagctaaccagtcatgaagaatggagtcactataatgaaaacataagagaaggtcaaaaagattttgtttttgtgaagttcaatggccttcatttaaagtctatggaaaatttgcagtcttgcatctctcttagagtatgcatcttctcaaacaattttattacagatattcatccacttcaaagttgtataaaattaatcaaacttgatctccatggaaatcagataaagagtctaccaaataccaaattttggaatggattgaagaacctaaaactactctatcttcatgacaatgggtttgcaaagttaaagaatatatgtgtattatctgcctgtccaaccctcattgccctcactatgtttgattgtccagtaagccttaaaaaaggatatagacatgttcttgttaacagtatatggcctctcaaagcgctggatcatcatgtgatttctgatgaagaaataattcagaactggcatcttcctgaaagattcaaagcatgtaaccatcgacttttctttaatttctgcccagctttgagaaagggaacaacctatgaagaggaaattaataatattaaacatattacttcaaaaattaatgcaattctggctcataattcaccagttttgattgttcaaagatggatacgtggtttcttagttagaaaaaatttgagccctgtgtttttccacaaaaaaaaacagcaggaaaaaattattagaggatatgaagcaaaatggatttacataaccaaagggtatgaagataagctccttaaggatctctttttcaaacctgaaactaatataaaaggaaagcttgcatattggaaacataatatatattatcctgttgatttaaaaaattccagtgaacacagaaaacatgtgtcatctattttatgtgaattaaaaccaaaagatctaggcatgaaatcaaaaacatcaagacatctcattcaaaaaggtcaggagtctgaagatgaaattgtggatgaaaaattggataccagttttaggatatcagttttcaaactacccatatacacttcaggttcattgaagaataatgcagtattgagagagaaaaaacaacatttttttcctgcatatcctcagccaatctatactactcatccaaagccaatcattaaaaaagacatacgattggagcggagtatgaaagagttttttgcaccacaaagagctggtatgaaactccgaacatttagtgatattgacaaatattacacagaacaaaagaagcaggaataccataaagaaaaagtaagagttgtagccatggcacaagttgctcgagaaagagttagagtagctgttaatgaacatttgaatcagaaaaaatatgctacacaaaaactaattgaagaaaataaagagacaattcagaacagtttacgacaagtttggcaaaacagattcaactaccttgaaaaagctagagagagaaaagctctgtttctaaaagaaaaatcccaaaaggcttcagagcgtttattagttcaaaacttaaataatgagcgcactcttttgaccagaggactacttaaaattgacagactggagaagaatgaggctgtcctaaaagagaaaagcctgattgttaagcaaaaactaaaagcagaaaaatatagaaagaatttacttaaagaaatgaaaaaagttagatctcaagaaatatataaaagacattgtgaagaaaaatttgttatggatatgattgcctttgaaaaagcctgtgaaagacttcaagatgctaaaacaaaagtagcaattgtgaaaacaaatttagactttaaagttcccaatggactgataaaatgaatcaatgccagatcacatcctatgatcatcttaaattatagtcattatttttagttgaaggaatttgaaataatactctaaagcaagaaatactctacatcacaagatggatttatatataagtcttctaaaaatataaagattagttaaaatgtttctcttattggtcataatttaacttaaagttgacttagcacctctgaaaaatttcttagatcagatgcctaaggaacaattaaactgatttaatgtattgcagacaatgttgcaatgacattgctgatattctgtttcatattctttctaaatatagcaattcataagctaatttaggtttttctggaaaccttagaatagtaatttctactccaactgctgacttttattaagacactgtgtacgttgatgacttttattacctgcttttatatatttcctgcttattttgttaaaacaatttctgaatttattttttaaagtatggtttcaatattttgtcagtgatatatgctgttataaaaattcagaaaatatgaactatgaaaagtaaattaaacattcttatcaccttccttgaagactgtaagatttttgtatatttacttttgatgggtttgccctgtttggtatacatgtgaagacagggaaaagacagaggagagaagcaagagacaacccatataattatatattggaatcataaaatatacagaaatggtatatattaaccataagtctgtttaatacataccaatggtagaaaatttgaaaaataaactgtt

SEQ ID NO: 148416 - DNA, 793 bp, Homo sapiens
  Payload ID: 9393
  Gene Symbol: LRRIQ3
  Gene Name: leucine-rich repeats and IQ motif containing 3
  ENST ID: ENST00000370909
  CDS Start-End: 161-736
tggctggcgcccggaaaaccatgatgtggagaacttggatgttgtcttgtttctctagcaacggtctcaggagcagatggccgcccagcgatttgtctgactgtgttggggctgggccacttgtctccaactcataagggcttgcagcccagttgacccgatgtttcatggaacagtcacagaagagctaaccagtcatgaagaatggagtcactataatgaaaacataagagaaggtcaaaaagattttgtttttgtgaagttcaatggccttcatttaaagtctatggaaaatttgcagtcttgcatctctcttagagtatgcatcttctcaaacaattttattacagatattcatccacttcaaagttgtataaaattaatcaaacttgatctccatggaaatcagggaacaacctatgaagaggaaattaataatattaaacatattacttcaaaaattaatgcaattctggctcataattcaccagttttgattgttcaaagatggatacgtggtttcttagttagaaaaaatttgagccctgtgtttttccacaaaaaaaaacagcaggaaaaaattattagaggatatgaagcaaaatggatttacataaccaaagggtatgaagataagctccttaaggatctctttttcaaacctgaaactaatataaaaggaaagcttgcatattggaaacatgataaaaaaaaattatgggtcaattttcactgaagtgggctggatgtgtgtattcatctctcatcagtgccaaaaggaattatgcacatc

SEQ ID NO: 148417 - DNA, 1591 bp, Homo sapiens
  Payload ID: 9393
  Gene Symbol: LRRIQ3
  Gene Name: leucine-rich repeats and IQ motif containing 3
  Uniprot ID: A6PVS8
  ENST ID: ENST00000370911
  CDS Start-End: 153-752
gcccggaaaaccatgatgtggagaacttggatgttgtcttgtttctctagcaacggtctcaggagcagatggccgcccagcgatttgtctgactgtgttggggctgggccacttgtctccaactcataagggcttgcagcccagttgacccgatgtttcatggaacagtcacagaagagctaaccagtcatgaagaatggagtcactataatgaaaacataagagaaggtcaaaaagattttgtttttgtgaagttcaatggccttcatttaaagtctatggaaaatttgcagtcttgcatctctcttagagtatgcatcttctcaaacaattttattacagatattcatccacttcaaagttgtataaaattaatcaaacttgatctccatggaaatcagataaagagtctaccaaataccaaattttggaatggattgaagaacctaaaactactctatcttcatgacaatgggtttgcaaagttaaagaatatatgtgtattatctgcctgtccaaccctcattgccctcactatgtttgattgtccagtaagccttaaaaaaggatatagacatgttcttgttaacagtatatggcctctcaaagcgctggatcatcatgtgatttctgatgaagaaataattcagaactggcatcttcctgaaagattcaaagcatgtaaccatcgacttttctttaatttctgcccagctttgagaaaggagaaaatgaagcatagtgaggtttaggaacttacccaatattggacagcaaatgagtcatgaggtgggatttcaacaagtctgcagtcaacattgcatcacaaatgacagacagtgcagagatttgagtgtacttttcacactgagtgtggaaagaggagaagaataagtgtggaaatactcctctactattttgaagctggataactgggacagaaaagaacttatttaacagaaatggcagcacttaaagacttttggtgaaaagataagtttggtcatacttctttgaggcaggatattaaagaagaaataataactagacattggaaatgaaaaacaaaaattcagaaatagtgttctggacttgattgtaaattcaggagtatttgcttggggtcatagttaaagcctagttctctcaggtaaatacagggatcaataaaggctgaaaactaaggacacaaccttggggcactgtctcattttgtgggtagaaagcagtgtaaccaatgaagataaaggataattgatctcagcaggtaagagtaaaaaaaaaattaaatagaaaagaaaaaaacatattggaagaattttttatggtaaagaggatgtcgcatctttagaatttcaatagcttgcagttgttggacatgaaattgtggtgggttatatataactgccaagtatagaacctttactgagaatattttggacagaagaaaaataaagctttaactataggaaatagaatttatgaaagatttattaaagtgaagtggtacttgcctcactttaacttaccaaatatataatttaccatatttataaactgaggataaatgagttttgattagaaagagaaa

SEQ ID NO: 148418 - DNA, 2673 bp, Homo sapiens
  Payload ID: 9393
  Gene Symbol: LRRIQ3
  Gene Name: leucine-rich repeats and IQ motif containing 3
  Uniprot ID: A6PVS8
  ENST ID: ENST00000395089
  CDS Start-End: 1-1875
atgtttcatggaacagtcacagaagagctaaccagtcatgaagaatggagtcactataatgaaaacataagagaaggtcaaaaagattttgtttttgtgaagttcaatggccttcatttaaagtctatggaaaatttgcagtcttgcatctctcttagagtatgcatcttctcaaacaattttattacagatattcatccacttcaaagttgtataaaattaatcaaacttgatctccatggaaatcagataaagagtctaccaaataccaaattttggaatggattgaagaacctaaaactactctatcttcatgacaatgggtttgcaaagttaaagaatatatgtgtattatctgcctgtccaaccctcattgccctcactatgtttgattgtccagtaagccttaaaaaaggatatagacatgttcttgttaacagtatatggcctctcaaagcgctggatcatcatgtgatttctgatgaagaaataattcagaactggcatcttcctgaaagattcaaagcatgtaaccatcgacttttctttaatttctgcccagctttgagaaagggaacaacctatgaagaggaaattaataatattaaacatattacttcaaaaattaatgcaattctggctcataattcaccagttttgattgttcaaagatggatacgtggtttcttagttagaaaaaatttgagccctgtgtttttccacaaaaaaaaacagcaggaaaaaattattagaggatatgaagcaaaatggatttacataaccaaagggtatgaagataagctccttaaggatctctttttcaaacctgaaactaatataaaaggaaagcttgcatattggaaacataatatatattatcctgttgatttaaaaaattccagtgaacacagaaaacatgtgtcatctattttatgtgaattaaaaccaaaagatctaggcatgaaatcaaaaacatcaagacatctcattcaaaaaggtcaggagtctgaagatgaaattgtggatgaaaaattggataccagttttaggatatcagttttcaaactacccatatacacttcaggttcattgaagaataatgcagtattgagagagaaaaaacaacatttttttcctgcatatcctcagccaatctatactactcatccaaagccaatcattaaaaaagacatacgattggagcggagtatgaaagagttttttgcaccacaaagagctggtatgaaactccgaacatttagtgatattgacaaatattacacagaacaaaagaagcaggaataccataaagaaaaagtaagagttgtagccatggcacaagttgctcgagaaagagttagagtagctgttaatgaacatttgaatcagaaaaaatatgctacacaaaaactaattgaagaaaataaagagacaattcagaacagtttacgacaagtttggcaaaacagattcaactaccttgaaaaagctagagagagaaaagctctgtttctaaaagaaaaatcccaaaaggcttcagagcgtttattagttcaaaacttaaataatgagcgcactcttttgaccagaggactacttaaaattgacagactggagaagaatgaggctgtcctaaaagagaaaagcctgattgttaagcaaaaactaaaagcagaaaaatatagaaagaatttacttaaagaaatgaaaaaagttagatctcaagaaatatataaaagacattgtgaagaaaaatttgttatggatatgattgcctttgaaaaagcctgtgaaagacttcaagatgctaaaacaaaagtagcaattgtgaaaacaaatttagactttaaagttcccaatggactgataaaatgaatcaatgccagatcacatcctatgatcatcttaaattatagtcattatttttagttgaaggaatttgaaataatactctaaagcaagaaatactctacatcacaagatggatttatatataagtcttctaaaaatataaagattagttaaaatgtttctcttattggtcataatttaacttaaagttgacttagcacctctgaaaaatttcttagatcagatgcctaaggaacaattaaactgatttaatgtattgcagacaatgttgcaatgacattgctgatattctgtttcatattctttctaaatatagcaattcataagctaatttaggtttttctggaaaccttagaatagtaatttctactccaactgctgacttttattaagacactgtgtacgttgatgacttttattacctgcttttatatatttcctgcttattttgttaaaacaatttctgaatttattttttaaagtatggtttcaatattttgtcagtgatatatgctgttataaaaattcagaaaatatgaactatgaaaagtaaattaaacattcttatcaccttccttgaagactgtaagatttttgtatatttacttttgatgggtttgccctgtttggtatacatgtgaagacagggaaaagacagaggagagaagcaagagacaacccatataattatatattggaatcataaaatatacagaaatggtatatattaaccataagtctgtttaatacataccaatggtagaaaatttgaaaaataaactgttaaaaaagacagaaaaa

SEQ ID NO: 148419 - DNA, 1085 bp, Homo sapiens
  Payload ID: 9393
  Gene Symbol: LRRIQ3
  Gene Name: leucine-rich repeats and IQ motif containing 3
  ENST ID: ENST00000417067
  CDS Start-End: 1-183
aatatatattatcctgttgatttaaaaaattccagtgaacacagaaaacatgtgtcatctattttatgtgaattaaaaccaaaagatctaggcatgaaatcaaaaacatcaagacatctcattcaaaaagatctcaagaaatatataaaagacattgtgaagaaaaatttgttatggatatgattgcctttgaaaaagcctgtgaaagacttcaagatgctaaaacaaaagtagcaattgtgaaaacaaatttagactttaaagttcccaatggactgataaaatgaatcaatgccagatcacatcctatgatcatcttaaattatagtcattatttttagttgaaggaatttgaaataatactctaaagcaagaaatactctacatcacaagatggatttatatataagtcttctaaaaatataaagattagttaaaatgtttctcttattggtcataatttaacttaaagttgacttagcacctctgaaaaatttcttagatcagatgcctaaggaacaattaaactgatttaatgtattgcagacaatgttgcaatgacattgctgatattctgtttcatattctttctaaatatagcaattcataagctaatttaggtttttctggaaaccttagaatagtaatttctactccaactgctgacttttattaagacactgtgtacgttgatgacttttattacctgcttttatatatttcctgcttattttgttaaaacaatttctgaatttattttttaaagtatggtttcaatattttgtcagtgatatatgctgttataaaaattcagaaaatatgaactatgaaaagtaaattaaacattcttatcaccttccttgaagactgtaagatttttgtatatttacttttgatgggtttgccctgtttggtatacatgtgaagacagggaaaagacagaggagagaagcaagagacaacccatataattatatattggaatcataaaatatacagaaatggtatatattaaccataagtctgtttaatacataccaatggtagaaaatttgaaaaataaactgttaaaaaagacagaaaaa

SEQ ID NO: 148420 - DNA, 372 bp, Homo sapiens
  Payload ID: 9393
  Gene Symbol: LRRIQ3
  Gene Name: leucine-rich repeats and IQ motif containing 3
  ENST ID: ENST00000444984
  CDS Start-End: 1-316
aaacaattttattacagatattcatccacttcaaagttgtataaaattaatcaaacttgatctccatggaaatcagggaacaacctatgaagaggaaattaataatattaaacatattacttcaaaaattaatgcaattctggctcataattcaccagttttgattgttcaaagatggatacgtggtttcttagttagaaaaaatttgagactgttacagtcctctgaatttaaggattgcttgaagatgtgtccaagaaagcgagaaaaaaaaaacattttttttctaatttttaagttgatagaaaaatattaatctagtttccttgaaatataaaatctattgaaaataaagaaatgtttcatgttaaa

SEQ ID NO: 148421 - DNA, 4524 bp, Homo sapiens
  Payload ID: 9393
  Gene Symbol: LRRIQ3
  Gene Name: leucine-rich repeats and IQ motif containing 3
  Uniprot ID: A6PVS8
  ENST ID: ENST00000415760
  CDS Start-End: 193-1092
gtcgcccacgtaaccacgcccccggagcgccttggctggcgcccggaaaaccatgatgtggagaacttggatgttgtcttgtttctctagcaacggtctcaggagcagatggccgcccagcgatttgtctgactgtgttggggctgggccacttgtctccaactcataagggcttgcagcccagttgacccgatgtttcatggaacagtcacagaagagctaaccagtcatgaagaatggagtcactataatgaaaacataagagaaggtcaaaaagattttgtttttgtgaagttcaatggccttcatttaaagtctatggaaaatttgcagtcttgcatctctcttagagtatgcatcttctcaaacaattttattacagatattcatccacttcaaagttgtataaaattaatcaaacttgatctccatggaaatcagataaagagtctaccaaataccaaattttggaatggattgaagaacctaaaactactctatcttcatgacaatgggtttgcaaagttaaagaatatatgtgtattatctgcctgtccaaccctcattgccctcactatgtttgattgtccagtaagccttaaaaaaggatatagacatgttcttgttaacagtatatggcctctcaaagcgctggatcatcatgtgatttctgatgaagaaataattcagaactggcatcttcctgaaagattcaaagcatgtaaccatcgacttttctttaatttctgcccagctttgagaaagggaacaacctatgaagaggaaattaataatattaaacatattacttcaaaaattaatgcaattctggctcataattcaccagttttgattgttcaaagatggatacgtggtttcttagttagaaaaaatttgagccctgtgtttttccacaaaaaaaaacagcaggaaaaaattattagaggatatgaagcaaaatggatttacataaccaaagggtatgaagataagctccttaaggatctctttttcaaacctgaaactaatataaaaggaaagcttgcatattggaaacatgataaaaaaaaattatgggtcaattttcactgaagtgggctggatgtgtgtattcatctctcatcagtgccaaaaggaattatgcacatcattcattggacaacaggatgaaaacttgtctctgattggacactagggatatcagctgtacacacaagataagtgtaaagttgaaaagagaaatacacttagtaattcactcaagctagcatttattaacactttaaaacttgcattaaaatgttcatgatattatttccttcctcatataagaaagctaacattacaattcttaaattgaatgaaacataccatcataaaaattgctttgcagagactgctaatgcaaaaacttttaagctgttcatccttttttaatgaaaaagataataagatcaataaaagcaccattctttaccacttacttagaatgaatttttatttgttcaatgtaagagagattggctatttcaatgtgtttcaatattggtataagctttaaatgacaaagatttgtgttttatgacttacctatacatcaacagcactgaattttctcaaaacttatttaggcagcatgacttggaaggaaaatattaactattgaatcacactgatgctctctggtctagttaagatagttttttagatactccatataagcctgggttttgctgacaaaattcacctacaaagcccagagagacttacagtcacttgcaggcatttctttatattaaggcctttaaaaataaaatatacaagattctgacaacacttgccttaattgcttaagaacttaaaataagcttgttggtagaaatggtttgccaactagggcagttttgagtcaccttatccagtccccggaatattggagtcttgtaaataattaacatttgggcagtggctgaaatatttctgaccagagcagtaggcataaagttattaagcaagctatgctgaatacaatgtggagtgaaacagactaagatttgtactgaggctgtagaattttcaggctgcctaccttgggtgagtgatagcagtttactgagactgagcctcaggagatatatatgtacatacataagcacgtgtgtttgtgtgtgtgtattttctgccttgttatataatccatcatttgataaaaagagtccctgaagttttagagatacatgtggcatttggcggagaagaaacataactatacttcatatgagacagtcattttaggcttcagtattgtaataaaaacttacatgaagtaacacttaagaaatattctgaaatcctaaaatgaatatattgttccaagttgcagggggataaaacctcaattttagaaaatattattcaagtaattgttattgagtcaatttcataatttatcaatatgtgtttataaagtacatgcaagtagattgtaatatgccttactttagagatataattatatatatatagctactttgttaataggagacatttttctcatgaaaaaatataaatccctcctcagattcaaactcaaacttaaaacacataaattctaaattgctggattacttaaggtgtttaggtaaagtaagagcaaactaatcagtaataaaatattggcaagtccccgtttgtggcttttttctaaatctttcataaatatagacattgttcaaatatacttagaaatatagagtcttgagctatgtattttattgttaagaaaaaagaatttccctcttgaaaattccattttattgcccatcattaaattttacatgaccctatgaacttttcagaattgcaaattacttaagcagtgtaaactcatattactcatatacgtatgtctctttcattaaaatgattagatttataaattgaaaatattatcgtaactaattggcctaaaacatgaggtttaataaaatgcagattttaatcaggagcttaagaatttagcctatgctttctactatgtttttctcactttcaatgcctttttttcttgttttcacatctacatagggaaataatcagtaaattatgaaatattttgaaaaagacataatttaaatatttactaataataactttgtgcctatgtttaatattatgccatggatatagctgccattcaatacatagttgttgaataaactaatcaaatttattatccttttttgttgtttgtgacttgataatacaacagattgaagaatacaatcaaactggtgcggaaatatcaagataagtaaaccacaacctcagtcctcagagagagtaatttttactaggggttatccaaaatcatctgaagatatgttttcctgatctgacatagttcttcagaagtgaatatgaatatatattatcctgttgatttaaaaaattccagtgaacacagaaaacatgtgtcatctattttatgtgaattaaaaccaaaagatctaggcatgaaatcaaaaacatcaagacatctcattcaaaaaggtcaggagtctgaagatgaaattgtggatgaaaaattggataccagttttaggatatcagttttcaaactacccatatacacttcaggttcattgaagaataatgcagtattgagagagaaaaaacaacatttttttcctgcatatcctcagccaatctatactactcatccaaagccaatcattaaaaaagacatacgattggagcggagtatgaaagagttttttgcaccacaaagagctgatctcaagaaatatataaaagacattgtgaagaaaaatttgttatggatatgattgcctttgaaaaagcctgtgaaagacttcaagatgctaaaacaaaagtagcaattgtgaaaacaaatttagactttaaagttcccaatggactgataaaatgaatcaatgccagatcacatcctatgatcatcttaaattatagtcattatttttagttgaaggaatttgaaataatactctaaagcaagaaatactctacatcacaagatggatttatatataagtcttctaaaaatataaagattagttaaaatgtttctcttattggtcataatttaacttaaagttgacttagcacctctgaaaaatttcttagatcagatgcctaaggaacaattaaactgatttaatgtattgcagacaatgttgcaatgacattgctgatattctgtttcatattctttctaaatatagcaattcataagctaatttaggtttttctggaaaccttagaatagtaatttctactccaactgctgacttttattaagacactgtgtacgttgatgacttttattacctgcttttatatatttcctgcttattttgttaaaacaatttctgaatttattttttaaagtatggtttcaatattttgtcagtgatatatgctgttataaaaattcagaaaatatgaactatgaaaagtaaattaaacattcttatcaccttc

SEQ ID NO: 148422 - DNA, 1827 bp, Homo sapiens
  Payload ID: 9394
  Gene Symbol: LRRIQ4
  Gene Name: leucine-rich repeats and IQ motif containing 4
  Uniprot ID: A6NIV6
  ENST ID: ENST00000340806
  CDS Start-End: 1-1683
atgtcaaaagacataaaatcagtagaacattcacctaaaattcatcagagaaatgatccacagcacgtcaatgatagaacatttttcattgatgcctctaatcagagcttgactgccattcctttggagatcttcacattcacagaattagaagaagtgcatttggagaataaccagattgaagaaattccccaggagattcagcgtttaaagaacatcagggtcctctacctggataagaacaacctgaggagcctgtgcccggcgctggggctgctgagcagcctggagagcctggacctgagctacaaccccatcttctcctcctcccttgtcgttgtcagcttcctccacgccctgcgcgagctccggctctaccagaccgacctgaaggaaattcccgtcgtcatctttaaaaacctccaccatctcgagctgctcggactgaccggaaaccacctgaaatgtctgcccaaggaaatagtgaaccagaccaagctgagggagatctacctgaagcgaaaccagtttgaagttttcccccaggagctctgtgttctctacaccctggaaatcattgacctggacgagaacaaaataggtgccatcccagaagagatcggacacctgacggggctgcagaagttctatatggcttctaacaaccttcccgttctgcccgcgtccttgtgccagtgtagccaactgtcggtgctcgatttatcccacaacctcctccactccatcccgaagagcttcgccgagctcaggaagatgacggaaatcgggctgagcgggaaccgcctggagaaggtgccacgcctcatttgcaggtggacctcgctgcacctgctctacctgggaaacaccggcctgcacaggctgcggggctccttcaggtgcctggtcaacttgcgcttcctggacctaagccagaaccatctgcaccactgcccgctgcagatctgtgcactgaagaaccttgaagtcctgggactggatgacaataaaataggacagttaccttcagaattgggctcactttcaaaactgaagatacttggactaacaggaaatgagttcctttcctttccggaggaagtcctttctttagcgtctttagagaaattatacattgggcaagaccagggattcaaacttacctatgtgccagaacacattaggaaactgcagagtctcaaagagctatatatagagaacaatcatctggagtacctgcccgtatccttggggtcaatgcctaacctagaagttcttgattgccggcacaatttgcttaagcaacttccagatgccatttgccaagcacaagctttgaaagaattacggctggaggacaacttgctcacccatcttccagagaatttggattccctagtgaatcttaaggttctgacactgatggacaatcccatggaagaacccccaaaagaagtgtgtgctgaaggcaatgaggccatatggaaatacctcaaggaaaacagaaacaggaatataatggcaacaaagattcaggcatggtggcgtggaacaatggtacagagaggatttgggaaattcggtgaactactaaaaccacaaaagaaaggaaagacctctccaaaagataagaaaggaaagaaggatgtaaaaggaaaaccaggaaagggaaaaaagaaataatcctgtaaattgataaattggggtaatggaccttgatagattaagaagacaaaatatctaggaattagatgcctactacattaaaattattcataaaattacacttatgtgtaaaaataaatgattcttacttttactgaaata

SEQ ID NO: 148423 - DNA, 1423 bp, Homo sapiens
  Payload ID: 9395
  Gene Symbol: LRTM1
  Gene Name: leucine-rich repeats and transmembrane domains 1
  Uniprot ID: Q9HBL6
  ENST ID: ENST00000273286
  CDS Start-End: 164-1201
ttgaaagcaacaactgttttctgcattgaagaaaagcaagggcagggttcagaaagactgaatgtaaagctgggctctgagtctgccatgcccttcgtgtgttgctctgcacattaattaaagggtctacgaggtcagcaaggacgcccaaggagactcagtcatgaaaggtgaactgctcctgttttccagtgtgattgtcctgctccaggtggtatgcagctgcccggacaagtgttactgtcagtcatctacaaattttgtagactgcagccagcagggtctggccgaaatcccttcccatttacctcctcagactcgaacgctgcatttacaagataatcagatacaccatcttcctgcttttgcatttaggtcagtgccatggctcatgaccttaaacttgtccaacaattccctttcaaatctggcccctggagctttccatgggcttcagcacttgcaggttttaaatctaacccagaattcactcctttccctggaaagcagacttttccattccctccctcagctgagggagcttgatttgtcatcaaacaacataagccaccttcccacatccttgggagagacttgggagaacctaactatacttgcggttcaacaaaaccagcttcagcagcttgatcgagcgctcctggaatccatgcccagtgtgaggcttttacttctcaaggacaacctctggaaatgcaattgccacttgctcggtcttaaactctggctggagaaatttgtctataaagggggactaacagacggcatcatctgtgaatcaccagacacctggaagggaaaggacctccttaggatccctcatgagctgtaccagccctgccctcttcctgctcctgatccagtgtcctcgcaggctcagtggcccggctctgcccacggtgtggtcctgaggcctcctgagaaccacaacgcgggggagcgagaactcttggagtgcgagctcaaacccaagccaaggccggccaacctgcgtcatgccattgccactgtcatcatcactggcgttgtgtgtgggattgtgtgtctcatgatgttggcagctgccatctatggctgcacctatgcggcaatcacagcccagtaccatgggggacccttggctcaaaccaatgatcctgggaaggtggaagaaaaagagcgatttgacagctcaccagcctgagagcttttgtctcaaataggattggtcattgcaggccagaagatagtgtctgagtagggctgatgtgtttcctgttagtctgattttgcttttgccaaaagacaaaaaaaaaaaaaaaaaaaaaaagaaaaaaaaaagatgtgtctgtaaaaaatatttctggggaggaatttatgttgcgatttttaaaatactataggtaaaataaagatgatacttgtg

SEQ ID NO: 148424 - DNA, 1318 bp, Homo sapiens
  Payload ID: 9395
  Gene Symbol: LRTM1
  Gene Name: leucine-rich repeats and transmembrane domains 1
  Uniprot ID: Q9HBL6
  ENST ID: ENST00000493075
  CDS Start-End: 383-1192
aagcctctgaaatgcaccatgtcggtgcccaggctcattctgctctgccttaagtgtccttcgttctctggaccacagccttcccaagaatgaggacctgttcttgctccctgctggacccctgcctccagcaagatgctgagtacacagacgacccataggtgaactgctcctgttttccagtgtgattgtcctgctccaggtggtatgcagctgcccggacaagtgttactgtcagtcatctacaaattttgtagactgcagccagcagggtctggccgaaatcccttcccatttacctcctcagactcgaacgctgcatttacaagataatcagatacaccatcttcctgcttttgcatttaggtcagtgccatggctcatgaccttaaacttgtccaacaattccctttcaaatctggcccctggagctttccatgggcttcagcacttgcaggttttaaatctaacccagaattcactcctttccctggaaagcagacttttccattccctccctcagctgagggagcttgatttgtcatcaaacaacataagccaccttcccacatccttgggagagacttgggagaacctaactatacttgcggttcaacaaaaccagcttcagcagcttgatcgagcgctcctggaatccatgcccagtgtgaggcttttacttctcaaggacaacctctggaaatgcaattgccacttgctcggtcttaaactctggctggagaaatttgtctataaagggggactaacagacggcatcatctgtgaatcaccagacacctggaagggaaaggacctccttaggatccctcatgagctgtaccagccctgccctcttcctgctcctgatccagtgtcctcgcaggctcagtggcccggctctgcccacggtgtggtcctgaggcctcctgagaaccacaacgcgggggagcgagaactcttggagtgcgagctcaaacccaagccaaggccggccaacctgcgtcatgccattgccactgtcatcatcactggcgttgtgtgtgggattgtgtgtctcatgatgttggcagctgccatctatggctgcacctatgcggcaatcacagcccagtaccatgggggacccttggctcaaaccaatgatcctgggaaggtggaagaaaaagagcgatttgacagctcaccagcctgagagcttttgtctcaaataggattggtcattgcaggccagaagatagtgtctgagtagggctgatgtgtttcctgttagtctgattttgcttttgccaaaagacaaaaaaaaaaaaaaaaaaaaaaa

SEQ ID NO: 148425 - DNA, 3688 bp, Homo sapiens
  Payload ID: 9396
  Gene Symbol: LRTM2
  Gene Name: leucine-rich repeats and transmembrane domains 2
  Uniprot ID: Q8N967
  ENST ID: ENST00000299194
  CDS Start-End: 545-1657
ccctttcttccctctctcctctctctctctccctccatccctctctttccttctcagtttgtgactgacccagcagccccgtcccccgtctgccacaagcagtccacctcctggtgctgtgtgctgcgtgccagccgctgctcccgctgagtggagactctggcaccagtgcccactgcgctctgcctgccggtggtgtctggatttctataggaatcccaggagggtcttactggagggttgagagccacctgattgaaggcgtttgcagtcagagtaaagacggctgccgcagcatgaacccctgagctgatgagtcttattatagcccggctggcggaagacagagtgctgctattcacctctgcgtgggcgtcggtggtgcagggggaagcagcaggccatccagcggctcacaccctacgcggctgcagctgccaagggcctggcccctgcctccctcgggccatggactgacaggcggcgcacccaggggctcctctctccccagagcgacagggcccggagagccgtgggcctcaccatgctggcgccgggcagcagccctgggcagaggggcaggctcgccctgcagtggaggcaagtctcctggatcacctgctggatcgccctgtatgctgtggaggccctccccacctgccctttctcctgcaagtgtgacagccgcagcctggaggtggactgcagtggccttggcctcaccacggtgcccccagacgtgcccgcagccacccgaaccctcttgctcttgaacaataagctgagtgccctgccaagctgggctttcgccaacctctccagcctgcagcggttggacctgtccaacaacttcctggaccggctgccccgctccattttcggggacctgacgaatctgactgagcttcagctgcgcaataacagcatcaggaccctggacagggacctgctgcggcactcgccgctgctccgccacctggacctgtccatcaacggcctggcccagttgccccctggtcttttcgacgggctcctggctctgcgctccctctcgcttcgctccaaccgtctgcagaatctggaccggctgacatttgaacccctagcaaacctgcagctgctgcaggtcggggataacccctgggagtgtgactgtaacctgcgtgagttcaaacactggatggagtggttctcctaccgagggggacgcttggaccagcttgcctgcaccctgcccaaggagctgagggggaaggacatgcggatggtccccatggagatgttcaactactgctcccagctggaggacgagaatagctcagctgggctggatattcctgggccaccctgcaccaaggccagtccagagcctgctaagcccaagcccggggctgagccggagccggagcccagcacagcctgcccacagaagcagaggcaccggccggcgagcgtgaggcgagccatgggcacggtgatcattgcaggggtcgtgtgcggcgtcgtctgcatcatgatggtggtggccgctgcctatggctgcatctacgcctccctcatggccaagtaccaccgggagctcaaaaagcgccagcccctgatgggggaccccgagggcgagcacgaggaccagaagcagatctcttctgtggcctgagcgcccatccccacccggccaggtaggaagggcggggagagcacacggcattgctcagccacagctcccaccttgacccggcgctggccactgcctccccgagtccaccctcctccccgccctccagcagacaagccacaccgggttctctccctgcactttcgaggctccctgaaagccaccgtgctgggggctcctgctgatgctcctgtctgggccagtaaatctttggaacatgtgggggatctccctaagctctggccacagcaaagcaaggaggtgtgtgcaagaggaggcttccggactgggcattcccctgtcgcccttcctgccctggggtggccatagctggtgactcttcctaccttgctggtcccacctcacctgcattgaggggacggggagggagggatctgagggatgaaggtagatttctgagactctctcctaagccagaaagacgttcttaacacccctgcagtgtgaaagctggtccagctctacaactgttggtaccaatgtgcaaacacaccagccctgccatctggacccagcactcagaaacaccatacacccctggccgacgccatcatgcccctggatctgctataggccacactgaccacatgctcctggattcgctaattcactcacacacccattgcatcaccagtgcggtcacatggattgaaagaattaatacacacacacacacacacacactcacacggtcacacggagaccgaggctatgagcgctcgaacagcagagacatgctcttccccaggggtctccctgagaccacagagcctctcgcgtgctcactgcaatcttctcaagtcaacagcaggaaggaactcaaccagtaacaccaggatcctttgagatcctctaaagtgggccaaagtggtgcccctggaggagccctcctgtcaccatggtaaccctctcacacctctcctgctgggctttcccgggataccacccaggggcctggagcggctgcatgtgtgcatggcggcctcctgaggacccagccacacaccactggtgttgcctcggtcctgcccacgcatctcacagcaccaggccctgtggggcccccactgattcctccacagcctgcagcctggcaccgtgactctgtgcctctcgccctccatcttcagtactcctggcctgtgacttcagggctgggacttggtggtgctttgccattggtggcaccctctggggaaagcaggtggcaggcagagaacacggtggctcccctgaggctcattgcctgccagcttattgcagacagagcccaggagcaggagcgggtggccacgtgctgcccagaggctcccaggatggggcctctgttcccgggctttgtctgctcagtgtggctccctagagcacccagccggggccaaaccagagagtgggtggggagcctgtctgggacagagccacctgctgccaaggcagtgcaagttttccaggttacctgtccccctccctagctctgcccctcctcagagtgtgaagatggtgggtacctaggtgtcatgctcacaggctcaggaggcatcaggctcgtccctggctctgggatggaatctcgatgggggctcaggaagaggccagcaagaaccctgaagccaagggtctgagcagagggagttggcaggcctagctcctgtgccccactccgaccctccctgctcatgcggcagtgggtgggtgaggtgggctgggggcctggaggagtgcctttgaggaggtcagtcctggcaggtggacagaggacgcctggcatgggctgcttactgggaccccaggcggccctggccatggccacagtcttccttcttttggcgtgtgggctggtaccagatctggggattttctaaagggactggggggaggggagggcattgtcaatggtggtatctttagcctgagacagaagatttttaaaggcaaaattatatttctggtttgttgtttcagaagaccaataaagactgtattttcctatgt

SEQ ID NO: 148426 - DNA, 597 bp, Homo sapiens
  Payload ID: 9396
  Gene Symbol: LRTM2
  Gene Name: leucine-rich repeats and transmembrane domains 2
  ENST ID: ENST00000546167
  CDS Start-End: 319-597
aaagaaagtctcagcactgccaaaagagggagaccaggaaagccaggcccgcggggagggctgccgcagcatgaacccctgagctgatgagtcttattatagcccggctggcggaagacagagtgctgctattcacctctgcgtgggcgtcggtggtgcagggggaagcagcaggccatccagcggctcacaccctacgcggctgcagctgccaagggcctggcccctgcctccctcgggccatggactgacaggcggcgcacccaggggctcctctctccccagagcgacagggcccggagagccgtgggcctcaccatgctggcgccgggcagcagccctgggcagaggggcaggctcgccctgcagtggaggcaagtctcctggatcacctgctggatcgccctgtatgctgtggaggccctccccacctgccctttctcctgcaagtgtgacagccgcagcctggaggtggactgcagtggccttggcctcaccacggtgcccccagacgtgcccgcagccacccgaaccctcttgctcttgaacaataagctgagtgccctgccaagctgggctttcgccaacctctccagc

SEQ ID NO: 148427 - DNA, 587 bp, Homo sapiens
  Payload ID: 9396
  Gene Symbol: LRTM2
  Gene Name: leucine-rich repeats and transmembrane domains 2
  ENST ID: ENST00000543694
  CDS Start-End: 301-587
gcgcagaagcctgagaggaagggtgcggacaccaggtctgtgctgccgcagcatgaacccctgagctgatgagtcttattatagcccggctggcggaagacagagtgctgctattcacctctgcgtgggcgtcggtggtgcagggggaagcagcaggccatccagcggctcacaccctacgcggctgcagctgccaagggcctggcccctgcctccctcgggccatggactgacaggcggcgcacccaggggctcctctctccccagagcgacagggcccggagagccgtgggcctcaccatgctggcgccgggcagcagccctgggcagaggggcaggctcgccctgcagtggaggcaagtctcctggatcacctgctggatcgccctgtatgctgtggaggccctccccacctgccctttctcctgcaagtgtgacagccgcagcctggaggtggactgcagtggccttggcctcaccacggtgcccccagacgtgcccgcagccacccgaaccctcttgctcttgaacaataagctgagtgccctgccaagctgggctttcgccaacctctccagcctgcagcg

SEQ ID NO: 148428 - DNA, 3236 bp, Homo sapiens
  Payload ID: 9396
  Gene Symbol: LRTM2
  Gene Name: leucine-rich repeats and transmembrane domains 2
  Uniprot ID: Q8N967
  ENST ID: ENST00000535041
  CDS Start-End: 446-1558
tccacctcctggtgctgtgtgctgcgtgccagccgctgctcccgctgagtggagactctggcaccagtgcccactgcgctctgcctgccggtggtgtctggatttctataggaatcccaggagggtcttactggagggttgagagccacctgattgaaggcgtttgcagtcagagtaaagacggcagctgccgcagcatgaacccctgagctgatgagtcttattatagcccggctggcggaagacagagtgctgctattcacctctgcgtgggcgtcggtggtgcagggggaagcagcaggccatccagcggctcacaccctacgcggctgcagctgccaagggcctggcccctgcctccctcgggccatggactgacaggcggcgcacccaggggctcctctctccccagagcgacagggcccggagagccgtgggcctcaccatgctggcgccgggcagcagccctgggcagaggggcaggctcgccctgcagtggaggcaagtctcctggatcacctgctggatcgccctgtatgctgtggaggccctccccacctgccctttctcctgcaagtgtgacagccgcagcctggaggtggactgcagtggccttggcctcaccacggtgcccccagacgtgcccgcagccacccgaaccctcttgctcttgaacaataagctgagtgccctgccaagctgggctttcgccaacctctccagcctgcagcggttggacctgtccaacaacttcctggaccggctgccccgctccattttcggggacctgacgaatctgactgagcttcagctgcgcaataacagcatcaggaccctggacagggacctgctgcggcactcgccgctgctccgccacctggacctgtccatcaacggcctggcccagttgccccctggtcttttcgacgggctcctggctctgcgctccctctcgcttcgctccaaccgtctgcagaatctggaccggctgacatttgaacccctagcaaacctgcagctgctgcaggtcggggataacccctgggagtgtgactgtaacctgcgtgagttcaaacactggatggagtggttctcctaccgagggggacgcttggaccagcttgcctgcaccctgcccaaggagctgagggggaaggacatgcggatggtccccatggagatgttcaactactgctcccagctggaggacgagaatagctcagctgggctggatattcctgggccaccctgcaccaaggccagtccagagcctgctaagcccaagcccggggctgagccggagccggagcccagcacagcctgcccacagaagcagaggcaccggccggcgagcgtgaggcgagccatgggcacggtgatcattgcaggggtcgtgtgcggcgtcgtctgcatcatgatggtggtggccgctgcctatggctgcatctacgcctccctcatggccaagtaccaccgggagctcaaaaagcgccagcccctgatgggggaccccgagggcgagcacgaggaccagaagcagatctcttctgtggcctgagcgcccatccccacccggccaggtaggaagggcggggagagcacacggcattgctcagccacagctcccaccttgacccggcgctggccactgcctccccgagtccaccctcctccccgccctccagcagacaagccacaccgggttctctccctgcactttcgaggctccctgaaagccaccgtgctgggggctcctgctgatgctcctgtctgggccagtaaatctttggaacatgtgggggatctccctaagctctggccacagcaaagcaaggaggtgtgtgcaagaggaggcttccggactgggcattcccctgtcgcccttcctgccctggggtggccatagctggtgactcttcctaccttgctggtcccacctcacctgcattgaggggacggggagggagggatctgagggatgaaggtagatttctgagactctctcctaagccagaaagacgttcttaacacccctgcagtgtgaaagctggtccagctctacaactgttggtaccaatgtgcaaacacaccagccctgccatctggacccagcactcagaaacaccatacacccctggccgacgccatcatgcccctggatctgctataggccacactgaccacatgctcctggattcgctaattcactcacacacccattgcatcaccagtgcggtcacatggattgaaagaattaatacacacacacacacacacacactcacacggtcacacggagaccgaggctatgagcgctcgaacagcagagacatgctcttccccaggggtctccctgagaccacagagcctctcgcgtgctcactgcaatcttctcaagtcaacagcaggaaggaactcaaccagtaacaccaggatcctttgagatcctctaaagtgggccaaagtggtgcccctggaggagccctcctgtcaccatggtaaccctctcacacctctcctgctgggctttcccgggataccacccaggggcctggagcggctgcatgtgtgcatggcggcctcctgaggacccagccacacaccactggtgttgcctcggtcctgcccacgcatctcacagcaccaggccctgtggggcccccactgattcctccacagcctgcagcctggcaccgtgactctgtgcctctcgccctccatcttcagtactcctggcctgtgacttcagggctgggacttggtggtgctttgccattggtggcaccctctggggaaagcaggtggcaggcagagaacacggtggctcccctgaggctcattgcctgccagcttattgcagacagagcccaggagcaggagcgggtggccacgtgctgcccagaggctcccaggatggggcctctgttcccgggctttgtctgctcagtgtggctccctagagcacccagccggggccaaaccagagagtgggtggggagcctgtctgggacagagccacctgctgccaaggcagtgcaagttttccaggttacctgtccccctccctagctctgcccctcctcagagtgtgaagatggtgggtacctaggtgtcatgctcacaggctcaggaggcatcaggctcgtccctggctctgggatggaatctcgatgggggctcaggaagaggccagcaagaaccctgaagccaagggtctgagcagagggagttggcag

SEQ ID NO: 148429 - DNA, 3986 bp, Homo sapiens
  Payload ID: 9396
  Gene Symbol: LRTM2
  Gene Name: leucine-rich repeats and transmembrane domains 2
  Uniprot ID: Q8N967
  ENST ID: ENST00000543818
  CDS Start-End: 843-1955
ggaggcgcaggatggaagatggaggtggtggtgaaaccgctttcctcctccctgtggtcggcagcgattcatccacaggcgcctttttccactgaaatgtgagcgtggccagggtgagcgctgccctcgcggccggccgtggtgcctctggtgtgcgcctgtgtgtgctgctgccgctgtcatcacagatgcaccccagctgtcactccccgctccactctggctcgctgctcgcgcacacgcgtgcgctctcctccctcgcccctttcttccctctctcctctctctctctccctccatccctctctttccttctcagtttgtgactgacccagcagccccgtcccccgtctgccacaagcagtccacctcctggtgctgtgtgctgcgtgccagccgctgctcccgctgagtggagactctggcaccagtgcccactgcgctctgcctgccggtggtgtctggatttctataggaatcccaggagggtcttactggagggttgagagccacctgattgaaggcgtttgcagtcagagtaaagacggctgccgcagcatgaacccctgagctgatgagtcttattatagcccggctggcggaagacagagtgctgctattcacctctgcgtgggcgtcggtggtgcagggggaagcagcaggccatccagcggctcacaccctacgcggctgcagctgccaagggcctggcccctgcctccctcgggccatggtgagctgtggcggggctagaggaaccgggacccaggactgacaggcggcgcacccaggggctcctctctccccagagcgacagggcccggagagccgtgggcctcaccatgctggcgccgggcagcagccctgggcagaggggcaggctcgccctgcagtggaggcaagtctcctggatcacctgctggatcgccctgtatgctgtggaggccctccccacctgccctttctcctgcaagtgtgacagccgcagcctggaggtggactgcagtggccttggcctcaccacggtgcccccagacgtgcccgcagccacccgaaccctcttgctcttgaacaataagctgagtgccctgccaagctgggctttcgccaacctctccagcctgcagcggttggacctgtccaacaacttcctggaccggctgccccgctccattttcggggacctgacgaatctgactgagcttcagctgcgcaataacagcatcaggaccctggacagggacctgctgcggcactcgccgctgctccgccacctggacctgtccatcaacggcctggcccagttgccccctggtcttttcgacgggctcctggctctgcgctccctctcgcttcgctccaaccgtctgcagaatctggaccggctgacatttgaacccctagcaaacctgcagctgctgcaggtcggggataacccctgggagtgtgactgtaacctgcgtgagttcaaacactggatggagtggttctcctaccgagggggacgcttggaccagcttgcctgcaccctgcccaaggagctgagggggaaggacatgcggatggtccccatggagatgttcaactactgctcccagctggaggacgagaatagctcagctgggctggatattcctgggccaccctgcaccaaggccagtccagagcctgctaagcccaagcccggggctgagccggagccggagcccagcacagcctgcccacagaagcagaggcaccggccggcgagcgtgaggcgagccatgggcacggtgatcattgcaggggtcgtgtgcggcgtcgtctgcatcatgatggtggtggccgctgcctatggctgcatctacgcctccctcatggccaagtaccaccgggagctcaaaaagcgccagcccctgatgggggaccccgagggcgagcacgaggaccagaagcagatctcttctgtggcctgagcgcccatccccacccggccaggtaggaagggcggggagagcacacggcattgctcagccacagctcccaccttgacccggcgctggccactgcctccccgagtccaccctcctccccgccctccagcagacaagccacaccgggttctctccctgcactttcgaggctccctgaaagccaccgtgctgggggctcctgctgatgctcctgtctgggccagtaaatctttggaacatgtgggggatctccctaagctctggccacagcaaagcaaggaggtgtgtgcaagaggaggcttccggactgggcattcccctgtcgcccttcctgccctggggtggccatagctggtgactcttcctaccttgctggtcccacctcacctgcattgaggggacggggagggagggatctgagggatgaaggtagatttctgagactctctcctaagccagaaagacgttcttaacacccctgcagtgtgaaagctggtccagctctacaactgttggtaccaatgtgcaaacacaccagccctgccatctggacccagcactcagaaacaccatacacccctggccgacgccatcatgcccctggatctgctataggccacactgaccacatgctcctggattcgctaattcactcacacacccattgcatcaccagtgcggtcacatggattgaaagaattaatacacacacacacacacacacactcacacggtcacacggagaccgaggctatgagcgctcgaacagcagagacatgctcttccccaggggtctccctgagaccacagagcctctcgcgtgctcactgcaatcttctcaagtcaacagcaggaaggaactcaaccagtaacaccaggatcctttgagatcctctaaagtgggccaaagtggtgcccctggaggagccctcctgtcaccatggtaaccctctcacacctctcctgctgggctttcccgggataccacccaggggcctggagcggctgcatgtgtgcatggcggcctcctgaggacccagccacacaccactggtgttgcctcggtcctgcccacgcatctcacagcaccaggccctgtggggcccccactgattcctccacagcctgcagcctggcaccgtgactctgtgcctctcgccctccatcttcagtactcctggcctgtgacttcagggctgggacttggtggtgctttgccattggtggcaccctctggggaaagcaggtggcaggcagagaacacggtggctcccctgaggctcattgcctgccagcttattgcagacagagcccaggagcaggagcgggtggccacgtgctgcccagaggctcccaggatggggcctctgttcccgggctttgtctgctcagtgtggctccctagagcacccagccggggccaaaccagagagtgggtggggagcctgtctgggacagagccacctgctgccaaggcagtgcaagttttccaggttacctgtccccctccctagctctgcccctcctcagagtgtgaagatggtgggtacctaggtgtcatgctcacaggctcaggaggcatcaggctcgtccctggctctgggatggaatctcgatgggggctcaggaagaggccagcaagaaccctgaagccaagggtctgagcagagggagttggcaggcctagctcctgtgccccactccgaccctccctgctcatgcggcagtgggtgggtgaggtgggctgggggcctggaggagtgcctttgaggaggtcagtcctggcaggtggacagaggacgcctggcatgggctgcttactgggaccccaggcggccctggccatggccacagtcttccttcttttggcgtgtgggctggtaccagatctggggattttctaaagggactggggggaggggagggcattgtcaatggtggtatctttagcctgagacagaagatttttaaaggcaaaattatatttctggtttgttgtttcagaagaccaataaagactgtattttcctatgt

SEQ ID NO: 148430 - DNA, 2215 bp, Homo sapiens
  Payload ID: 9397
  Gene Symbol: LRWD1
  Gene Name: leucine-rich repeats and WD repeat domain containing 1
  Uniprot ID: Q9UFC0
  ENST ID: ENST00000292616
  CDS Start-End: 153-2096
gcttccttccggtcgttaacgcccacgggctcgcgcggcgccgcctcctgggctcagttaccgcggacgccagtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggacctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagggggccacatcccagaccgtggccacgtgcggcggggaggctgtgtgcgtaattgattgccagacgggcatcgtgctccacaagtacaaggcacccggcgaggagttcttttctgtggcctggaccgctctgatggtggtcacacaggctggccacaagaagcgctggagtgtgctggcggctgcaggcctacggggcctggtccggctgctgcacgtgcgtgccggcttctgctgcggggtcatccgagcccacaagaaggccatcgccaccctgtgcttcagccccgcccacgagacccatctcttcacggcctcctatgacaagcggatcatcctctgggacatcggggtgcccaaccaggactacgaattccaggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcgtcttctctgagggctccgaggcatctggacggagagtggatgggctggcatttgtgaatgaggacatcgtggcctccaaggggagcggcctgggcaccatctgcctgtggagctggaggcagacgtgggggggccggggcagccagtccacggtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtgggggggggtctttcagtgaatatttttattaaactctactgtggacaagaa

SEQ ID NO: 148431 - DNA, 703 bp, Homo sapiens
  Payload ID: 9397
  Gene Symbol: LRWD1
  Gene Name: leucine-rich repeats and WD repeat domain containing 1
  ENST ID: ENST00000476270
  CDS Start-End: 1-124
ggcgcggctgctaatgcagcgcgggcgccccaagagcgaccggctggggaagatccggagtctggatggtgtggagtcgggagtagtggcgcgcgcttctagtcccagctactcgagaggctgaggcgggaggatccctcagcccaggagttggaggcagctgtgagctatgatcgcgcctaggcgactgagtgacaccccgtctctaaaaataaagtaacggggggatgggcggggcggctacacttgtacgagaaatgtcaggtgaaaaagccttctgaggtacccggggcagattggtgtagggtgcaaagcctgcccgccccctaagccttctgcccccaactccagcctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagg

SEQ ID NO: 148432 - DNA, 646 bp, Homo sapiens
  Payload ID: 9397
  Gene Symbol: LRWD1
  Gene Name: leucine-rich repeats and WD repeat domain containing 1
  ENST ID: ENST00000464107
  CDS Start-End: 81-218
gtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggatggtgtggagtcgggagtagtggcgcgcgcttctagtcccagctactcgagaggctgaggcgggaggatccctcagcccaggagttggaggcagctcctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactggg

SEQ ID NO: 148433 - DNA, 847 bp, Homo sapiens
  Payload ID: 9397
  Gene Symbol: LRWD1
  Gene Name: leucine-rich repeats and WD repeat domain containing 1
  ENST ID: ENST00000468175
  CDS Start-End: 1-728
agcggatcatcctctgggacatcggggtgcccaaccaggactacgaattccaggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcgtcttctctgagggctccgaggcatctggacggagagtggatgggctggcatttgtgaatgaggacatcgtggcctccaaggggagcggcctgggcaccatctgcctgtggagctggaggcagacgtgggggggccggggcagccagtccacggtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacagcccagccctcccctctctccccaccagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtgggggggggtctttcagtgaatatttttattaaactctactgtggacaagaa

SEQ ID NO: 148434 - DNA, 1062 bp, Homo sapiens
  Payload ID: 9397
  Gene Symbol: LRWD1
  Gene Name: leucine-rich repeats and WD repeat domain containing 1
  ENST ID: ENST00000463739
  CDS Start-End: 600-1062
ggctcgcgcggcgccgcctcctgggctcagttaccgcggacgccagtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggagtaagagccgggcagcggcctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagg

SEQ ID NO: 148435 - DNA, 908 bp, Homo sapiens
  Payload ID: 9397
  Gene Symbol: LRWD1
  Gene Name: leucine-rich repeats and WD repeat domain containing 1
  ENST ID: ENST00000485808
  CDS Start-End: 1-538
gagtctggacctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcggggctgggggcacctgggactctgcccagcttcctgatggcctggccccacccaggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagggggcca

SEQ ID NO: 148436 - DNA, 138 bp, Homo sapiens
  Payload ID: 9397
  Gene Symbol: LRWD1
  Gene Name: leucine-rich repeats and WD repeat domain containing 1
  ENST ID: ENST00000626402
  CDS Start-End: 1-138
atgggccccctctcggcgcggctgctaatgcagcgcgggcgccccaagagcgaccggctggggaagatccggagtctggatggtgtggagtcgggagtagtggcgcgcgcttctagtcccagctactcgagaggctga

SEQ ID NO: 148437 - DNA, 1870 bp, Homo sapiens
  Payload ID: 9398
  Gene Symbol: LSMEM1
  Gene Name: leucine-rich single-pass membrane protein 1
  Uniprot ID: Q8N8F7
  ENST ID: ENST00000312849
  CDS Start-End: 362-757
agtccaataaaaacctcatcagttaccaactaaatcagggcatggtgtttttttgttgttttctttttaaagcatagttttagtaatatatttactaaaaaccttagacattatgaaaaaagtcaggatttggaatcttacactgcttggctaaattgacacaatatagaccaacagtttcatcctggggcttatgggtctcataggagcacccgtatgctgaagaaaggcaaagagagaactacagaatttgtagaaaagttttgttgtagttgcttctgaacaattagtttttgtttgtttgttttgttttgttttgtttttctggtaacctagcagtcaaagctcacatttttggacaatgactcattcttcccaggacactggttcttgtggcattcaggaagatggaaagctttatgtggtggattccataaatgacttaaacaaactaaacctctgtccagccggatcgcagcatctgttccctctagaggacaaaatcccagtccttggcacaaactcaggaaatggaagccggagtctgttttttgtggggctgctaattgtgctgattgtcagcctggcactggtttttttcgtgatatttctaatagttcaaactggaaacaagatggatgatgtgtcaagaagactaacagctgaaggaaaagacatagatgatcttaagagaatcaataacatgatcgtaaagcgactcaaccaactcaaccaactggactctgaacaaaactaaaggaatgattttctgaaagcacctgctaacaccttgagctttttactttcctgggagtgtacagggttaggaactgagaaagtgcacttcctcaggcaacagatgatctggtcaggcaacccacccctggggcccactttctgcagcaagatgggagcaattccaaggcaagtgggtatgggaatagcaactaaaaaggggtgaacttgtctcagcccccttttatggtagggcacttcaactttaatggggtgggcggctagcagggaggagaatcaacaaagcaagagaacttgactatgtacgtccaacttcttacagaaggagctttgctaccagaacaagttcactgtgtcaatgaagttcatgacacctcatgcacctttacagatatctgggaaagcctgagaaattcattgagttttatgtattgaagggaaccaggtgattactcttttcaataagagggattctgctcaggtgattagactttgactctatttccccagggacagtgatgggtgggccccagagctagttgctgtctggtgtttgctggtgaaaacatgagcagtagttatgtggggctgagagtcaaaagggaaagcctaattaattcaactaatgtttattaagctcctactctgtgcaaatcactctactcaagaggagctcacataagagtgcaggataaagaaaggagatggacagttatatgtaattatataaactttgtgtattttgtttctcatgaaaaaacccctttggcaccctgctgattgatttggaagaaatctgatagatttgtggcctttcctaaattgcactaggaaattatgtagttagaatatttggaacctgcattagttccagcaatgaaagtaagacacacagcatatgacataagacacagtgtgaaataaatgagtttaaaaagcatatgagtcttagaaaatcttttatttaatataaaaatattctaccggtcaattgaagaatgtattatgattctatcattttggattgatcaaaaacatttgggtttactacgatattaagcattcactttacaatactaaatagttaatgaaataaacacattttgcttaccca

SEQ ID NO: 148438 - DNA, 730 bp, Homo sapiens
  Payload ID: 9398
  Gene Symbol: LSMEM1
  Gene Name: leucine-rich single-pass membrane protein 1
  Uniprot ID: Q8N8F7
  ENST ID: ENST00000439068
  CDS Start-End: 136-531
agtgtttgcaagtcagtcatcatagtggcagcttccgcctgctacaggatatttatatatggaagcataccatggcaggagtgctggaaaggtggtgtcagctaacagttgcttcagccagataaggacgggacaatgactcattcttcccaggacactggttcttgtggcattcaggaagatggaaagctttatgtggtggattccataaatgacttaaacaaactaaacctctgtccagccggatcgcagcatctgttccctctagaggacaaaatcccagtccttggcacaaactcaggaaatggaagccggagtctgttttttgtggggctgctaattgtgctgattgtcagcctggcactggtttttttcgtgatatttctaatagttcaaactggaaacaagatggatgatgtgtcaagaagactaacagctgaaggaaaagacatagatgatcttaagagaatcaataacatgatcgtaaagcgactcaaccaactcaaccaactggactctgaacaaaactaaaggaatgattttctgaaagcacctgctaacaccttgagctttttactttcctgggagtgtacagggttaggaactgagaaagtgcacttcctcaggcaacagatgatctggtcaggcaacccacccctggggcccactttctgcagcaagatgggagcaattccaaggcaagtgggtatgggaatagcaactaaaaagg

SEQ ID NO: 148439 - DNA, 819 bp, Homo sapiens
  Payload ID: 9398
  Gene Symbol: LSMEM1
  Gene Name: leucine-rich single-pass membrane protein 1
  Uniprot ID: Q8N8F7
  ENST ID: ENST00000455302
  CDS Start-End: 315-494
agtcatcatagtggcagcttccgcctgctacaggatatttatatatggaagcataccatggcaggagtgctggaaaggtggtgtcagctaacagttgcttcagccagataaggacggtgttccatcttaacataagtcaccaacttctaaacctggcactgggcatttgaagaataggattcgtccctactctaaggagttttcagtctatcgggaaatcaaagatgtaagcaaatagatgcaataaaatactacagatgttctgatagaagaatgtaaagaatccagcaaaggcaaaaggaaagacagggacaatgactcattcttcccaggacactggttcttgtggcattcaggaagatggaaagctttatgtggtggattccataaatgacttaaacaaactaaacctctgtccagccggatcgcagcatctgttcctgttaagacagtcttcaaagaactttccaaagaggtctaaggagatagcttaaccctgcttattccttgaataccaatagagaagaagctctagaggacaaaatcccagtccttggcacaaactcaggaaatggaagccggagtctgttttttgtggggctgctaattgtgctgattgtcagcctggcactggtttttttcgtgatatttctaatagttcaaactggaaacaagatggatgatgtgtcaagaagactaacagctgaaggaaaagacatagatgatcttaagagaatcaataacatgatcgtaaagcgactcaaccaactcaaccaactggactctgaacaaaactaaaggaatgattttctgaaagca

SEQ ID NO: 148440 - DNA, 1494 bp, Homo sapiens
  Payload ID: 9399
  Gene Symbol: LSMEM2
  Gene Name: leucine-rich single-pass membrane protein 2
  Uniprot ID: Q8N112
  ENST ID: ENST00000316436
  CDS Start-End: 88-582
ctattttaggccaaggctgggaggcagccaggccttccctgggctcacaaaggagccactgctgcatttgtccagtcctgctactggatgccatcattggcccccgactgcccactgcttgccatgcctgaggagacccaagaagactccgtggcgccaatgatgcccagccagaggagcagggggccattggcccccaaccacgtgcatgaggtatgcctgcaccaggtggagtccatcagcgacctacatagtggagcaggcacactgcgcccctatctaactgaagaggcacgaccgtgggatgagctgctgggcgttttgccgccgtcactgtgtgcccaggctggctgcagccctgtgtacagacgaggagggttcctgctgctgctcgcgctgctggtgctcacttgcctagtgctcgcactcctggctgtctacctgagcgtgctgcagagtgaatccctgcgcatcctggcacacacgctccgcacgcaggaggagacactactcaaactccgcttggccagcctcagccagcttcggaggctcaactccagtgaggcccaagcacccagctgagatgccatttggatctggggcctgggggtgtgtgttggtgggggaataaagtggctatgggcaggtctctccttccctactgctggctgccacatctacactatttccttggtgagatttttgtacaagaacctgttgttaacttaatggctgcctccctctcctgatctcttcaagccaggcctagccaagcctctggtgccaaagcctcgctttgggtggcccaaggtcaggggaaggggcaccagcctcctggctcctcctgtggcctgtcaacactctctggccaccccagatggcaggttctgaagtctagaaatagctgcccccatagcaatcacccaaactctgccagggctcccagtgagggtccagcctcagctcttaaagacaggctgggctctgagtagggggagaggcaccacctggggaagactgccttggagggcaaaggtgacatcgtggaagaccagttgggcccaagcctgggatagtagatggggagggagaacagaaaaatacccaggggttaagaccacagaaggctgaccgttctgtttaattatctgtaataatccttaaaaatcagcacacaaatccattccaggtagctttgccaccccacctgctgtggtggcatttgtccagatgccaccacccccctaagagtgggtcatcctgggggagcaaggcctgagaaaggaaaggaagggaaaggccccctagtgcctgccccacagccctgaggaaggcacatatttagcctggcctgagacaggacaggaaggggccacagggctgagtgcagggacaaaggggtcagggtcccaagtgtccgggcccccagctacccaccccatgtctgtttttggttttgtcattaaaaaaaataaagtgacaaatactggtgga

SEQ ID NO: 148441 - DNA, 1247 bp, Homo sapiens
  Payload ID: 9400
  Gene Symbol: LGI1
  Gene Name: leucine-rich, glioma inactivated 1
  Uniprot ID: O95970
  ENST ID: ENST00000371413
  CDS Start-End: 1-876
atggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgttattcacatcgaactcctttgatgtgatcagtgatgatgcttttattggtcttccacatctagagtatttattcatagaaaacaacaacatcaagtcaatttcaagacatactttccggggactaaagtcattaattcacttgagccttgcaaacaacaatctccagacactcccaaaagatattttcaaaggcctggattctttaacaaatgtggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggattttgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttca

SEQ ID NO: 148442 - DNA, 2381 bp, Homo sapiens
  Payload ID: 9400
  Gene Symbol: LGI1
  Gene Name: leucine-rich, glioma inactivated 1
  Uniprot ID: O95970
  ENST ID: ENST00000371418
  CDS Start-End: 337-2010
gaaagcagaaagctgtttattttctgtgacatcacttcactttgccttcgaaggctggtctgtgctcagtgttttcgtggtgatgcaagtcggctctctcctccagcagttggatccctcccatctcacagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgttattcacatcgaactcctttgatgtgatcagtgatgatgcttttattggtcttccacatctagagtatttattcatagaaaacaacaacatcaagtcaatttcaagacatactttccggggactaaagtcattaattcacttgagccttgcaaacaacaatctccagacactcccaaaagatattttcaaaggcctggattctttaacaaatgtggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggattttgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacaggcacatccactgtagtatgcaagcctatagtcattgaaactcagctctatgttattgtggcccagctgtttggtggctctcacatctataagcgagacagttttgcaaataaattcataaaaatccaggatattgaaattctcaaaatccgaaaacccaatgacattgaaacattcaagattgaaaacaactggtactttgttgttgctgacagttcaaaagctggttttactaccatttacaaatggaacggaaacggattctactcccatcaatccttacacgcgtggtacagggacactgatgtggaatatctagaaatagtcagaacacctcagacactcagaacgcctcatttaattctgtctagtagttcccagcgtcctgtaatttatcagtggaacaaagcaacacaattattcactaaccaaactgacattcctaacatggaggatgtgtacgcagtgaagcacttctcagtgaaaggggacgtgtacatttgcttgacaagattcattggtgattccaaagtcatgaaatggggaggctcctcgttccaggatattcagaggatgccatcgcgaggatccatggtgttccagcctcttcaaataaataattaccaatatgcaattcttggaagtgattactcctttactcaagtgtataactgggatgcagagaaagccaaatttgtgaaatttcaggaattaaatgttcaggcaccaagatcattcacacatgtgtccattaataagcgtaattttctttttgcttccagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttcatatcccagaggtaatta

SEQ ID NO: 148443 - DNA, 664 bp, Homo sapiens
  Payload ID: 9400
  Gene Symbol: LGI1
  Gene Name: leucine-rich, glioma inactivated 1
  ENST ID: ENST00000627699
  CDS Start-End: 70-288
ttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattgtaaggcccatcctttgtgagatctggttttactgaaatctcagaagggagttttttattcacgccatcgctgcagctcttgtgagaaatatttatatcatgactatttttaatatggcatatatttggataagccttctagtaaaatgatctcaatattaattttgtcaaatgtgattctatttctgagaaaacagaatatccgtaaagtgagaggtagatgggtttgtttgcgacttcacaccaacagtgcaggttgattcttacaatggtaaatctgttaacctgtcatgctgtctactttaatggctatttatgaagttgttggaatcttgcaacaatgatcccaattccattccactattttactttcattttta

SEQ ID NO: 148444 - DNA, 1751 bp, Homo sapiens
  Payload ID: 9400
  Gene Symbol: LGI1
  Gene Name: leucine-rich, glioma inactivated 1
  Uniprot ID: O95970
  ENST ID: ENST00000630047
  CDS Start-End: 175-1704
attgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgagccttgcaaacaacaatctccagacactcccaaaagatattttcaaaggcctggattctttaacaaatgtggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggattttgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacaggcacatccactgtagtatgcaagcctatagtcattgaaactcagctctatgttattgtggcccagctgtttggtggctctcacatctataagcgagacagttttgcaaataaattcataaaaatccaggatattgaaattctcaaaatccgaaaacccaatgacattgaaacattcaagattgaaaacaactggtactttgttgttgctgacagttcaaaagctggttttactaccatttacaaatggaacggaaacggattctactcccatcaatccttacacgcgtggtacagggacactgatgtggaatatctagaaatagtcagaacacctcagacactcagaacgcctcatttaattctgtctagtagttcccagcgtcctgtaatttatcagtggaacaaagcaacacaattattcactaaccaaactgacattcctaacatggaggatgtgtacgcagtgaagcacttctcagtgaaaggggacgtgtacatttgcttgacaagattcattggtgattccaaagtcatgaaatggggaggctcctcgttccaggatattcagaggatgccatcgcgaggatccatggtgttccagcctcttcaaataaataattaccaatatgcaattcttggaagtgattactcctttactcaagtgtataactgggatgcagagaaagccaaatttgtgaaatttcaggaattaaatgttcaggcaccaagatcattcacacatgtgtccattaataagcgtaattttctttttgcttccagttttaagggaaatacacagatttacaaacatgtcatagttgacttaagcgcatgagacaccaaattctgtggctgccatcagaaattttctacagtacatga

SEQ ID NO: 148445 - DNA, 600 bp, Homo sapiens
  Payload ID: 9400
  Gene Symbol: LGI1
  Gene Name: leucine-rich, glioma inactivated 1
  ENST ID: ENST00000478763
  CDS Start-End: 233-523
agcagttggatccctcccatctcacagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgtgagaaatatttatatcatgactatttttaatatggcatatatttggataagccttctagtaaaatgatctcaatattaa

SEQ ID NO: 148446 - DNA, 2936 bp, Homo sapiens
  Payload ID: 9400
  Gene Symbol: LGI1
  Gene Name: leucine-rich, glioma inactivated 1
  ENST ID: ENST00000630184
  CDS Start-End: 208-714
agtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattatcctttgtgagatctggttttactgaaatctcagaagggagttttttattcacgccatcgctgcagctcttgttattcacatcgaactcctttgatgtgatcagtgatgatgcttttattggtcttccacatctagagtatttattcatagaaaacaacaacatcaagtcaatttcaagacatactttccggggactaaagtcattaattcacttgagccttgcaaacaacaatctccagacactcccaaaagatattttcaaaggcctggattctttaacaaatgtgtaagaggacctaagaaatcactgaacaattaattaatttgcagtcattaacaaggaagcctggtattgattattataatttttaattggcttttaaattaaaattaggatttttaaatctaaattttaactggccaaaaatttaaatttacatggactaacatttgagtcttctatggtatttatcattgggaattctgaatacatggcacccaggcattcctttgacaaagtgtgtgtcaatacggcagggagcgatgataaaggactttgacggggtgggaagagacccggctagaaatttcaaaatcccttttttctcatgaggtccaggaaatagggctacaaaggaaaaacataaaggagtctgggaaactgacagaataaagatgaaaggttacatccttgggttggtcaatcaacagagaaatggaacaggaagtgggggaagggagaaaagtttgccttttttctcattagactgaacaacaactctaagcttaatccccaggaatttggcttaagccccaggaagggaatgaacttaattatttttgaccctttttcaaacaaaagagctttcaaactttgacttttaagcctccgagtgaaagatctttgcaaggaatttgtatattttgctgtaagcaaagcaagtaatatatgcctaaacttctcaaaagcaattcagcttcattatttgccttccagaacattagaaaggtatttaaatgtcataaggtggaagacaggaacaaatgaaaggatatatgaaaacaaaagcttttttaaaaaattattcaggtacttgtctgtagaatatatattcaaaacaacttttctccaataacaaacaaaaagaaaatctgagtcaagtactttcttccaagcccagtatttaacttcaaatcagtagcctaatgaaaaactttctttgttccttgcagtatttccccagcccctcctccatgtctattacctcaattcctgaatgatatggtttaattccaggagaatgcccaaatcaggattcttccaagagagtcctggacagaccatagttatcctctctggtttacagtagcctgaaaggttgccactcattagtgtgggtcagagttctcttgggagactaggtcagttctgggagtgtcttggaagttagaacacactccatgggtgacgtgggatgtagctcattgggggtcctttaccccatttttgtgtcagtctataccctacactagtgaaagacaaaacaaaaaaatattgaaattggctcagtctctcatgggaatcccaagatgggtttagccttttggacctactctaatatgcccaaatcaagaattatcttagaagtacaaggatccatgccaacttgccttttagtggatttcttggctttcttgaaagtatcctctaaaaaacatttttaaatgtttgggcgtttaaaaattatttatgtgtggtgtgaagagtaggcagcacctatcttaagaattctgtgtgaccaggaaaggaggtggaattcctgaacagaagcaatgcaaatacacagagaacttggtgagttggggtcatatgtggatatgtaaatggtctatgctgtataacttattacaggcatgagcgattgtatgcctgtgttaactctgctgtgtcaaagtcatttcctatttaaactgaatttgtagaccacggaagaggatcaggattaattatgtctgtgaggaagaagaaaagcaaatagctcacttgattaaatacattacaataatcactacattctgtcctttagacctgtgctgtccaatagggtagccaccagaccttatggtcactgagcacctaaaatgtgctcctagtacaactgagagactgaattttaaattttacttaattttttaacagttaaatttaaatttaaaagctgattctcagctcaattattggaaaatgttaagtacgcttggaataatttgggtatatacacctatttttttcaattatgaattttatgacatctaaatatagatcacctatttctggtaaaatttagcatctgaattgagatatattgtaggtataaaatacacactggacttcaaagacttagtataaaaaaggaatgtaaaatatctcaataatgtttatattgatgatgtgtcaaaatgataatcttttgtatgtattgggttaaataaaacatattattaaaatgaa

SEQ ID NO: 148447 - DNA, 1114 bp, Homo sapiens
  Payload ID: 9400
  Gene Symbol: LGI1
  Gene Name: leucine-rich, glioma inactivated 1
  ENST ID: ENST00000630487
  CDS Start-End: 271-489
cagtgttttcgtggtgatgcaagtcggctctctcctccagcagttggatccctcccatctcacagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattgtaaggcccatcctttgtgagatctggttttactgaaatctcagaagggagttttttattcacgccatcgctgcagctcttgttattcacatcgaactcctttgatgtgatcagtgatgatgcttttattggtcttccacatctagagtatttattcatagaaaacaacaacatcaagtcaatttcaagacatactttccggggactaaagtcattaattcacttgagccttgcaaacaacaatctccagacactcccaaaagatattttcaaaggcctggattctttaacaaatgtggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggattttgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacatta

SEQ ID NO: 148448 - DNA, 2251 bp, Homo sapiens
  Payload ID: 9400
  Gene Symbol: LGI1
  Gene Name: leucine-rich, glioma inactivated 1
  ENST ID: ENST00000629035
  CDS Start-End: 295-1896
tgccttcgaaggctggtctgtgctcagtgttttcgtggtgatgcaagtcggctctctcctccagcagttggatccctcccatctcacagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattgttattcacatcgaactcctttgatgtgatcagtgatgatgcttttattggtcttccacatctagagtatttattcatagaaaacaacaacatcaagtcaatttcaagacatactttccggggactaaagtcattaattcacttgagccttgcaaacaacaatctccagacactcccaaaagatattttcaaaggcctggattctttaacaaatgtggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggattttgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacaggcacatccactgtagtatgcaagcctatagtcattgaaactcagctctatgttattgtggcccagctgtttggtggctctcacatctataagcgagacagttttgcaaataaattcataaaaatccaggatattgaaattctcaaaatccgaaaacccaatgacattgaaacattcaagattgaaaacaactggtactttgttgttgctgacagttcaaaagctggttttactaccatttacaaatggaacggaaacggattctactcccatcaatccttacacgcgtggtacagggacactgatgtggaatatctagaaatagtcagaacacctcagacactcagaacgcctcatttaattctgtctagtagttcccagcgtcctgtaatttatcagtggaacaaagcaacacaattattcactaaccaaactgacattcctaacatggaggatgtgtacgcagtgaagcacttctcagtgaaaggggacgtgtacatttgcttgacaagattcattggtgattccaaagtcatgaaatggggaggctcctcgttccaggatattcagaggatgccatcgcgaggatccatggtgttccagcctcttcaaataaataattaccaatatgcaattcttggaagtgattactcctttactcaagtgtataactgggatgcagagaaagccaaatttgtgaaatttcaggaattaaatgttcaggcaccaagatcattcacacatgtgtccattaataagcgtaattttctttttgcttccagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttcat

SEQ ID NO: 148449 - DNA, 2278 bp, Homo sapiens
  Payload ID: 9400
  Gene Symbol: LGI1
  Gene Name: leucine-rich, glioma inactivated 1
  ENST ID: ENST00000627420
  CDS Start-End: 306-524
tcacttcactttgccttcgaaggctggtctgtgctcagtgttttcgtggtgatgcaagtcggctctctcctccagcagttggatccctcccatctcacagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgactgcatggaatcagaaagaagcaaaaggatgggaaatgcctgcattcccctgaaaagaattgcttatttcctatgtctcttatctgcgcttttgctgactgaggggaagaaaccagcgaagccaaaatgccctgccgtgtgtacttgtaccaaagataatgctttatgtgagaatgccagatccattccacgcaccgttcctcctgatgttatctcattgtaaggcccatcctttgtgagatctggttttactgaaatctcagaagggagttttttattcacgccatcgctgcagctcttgagccttgcaaacaacaatctccagacactcccaaaagatattttcaaaggcctggattctttaacaaatgtgtaagaggacctaagaaatcactgaacaattaattaatttgcagtcattaacaaggaagcctgggacctgaggggtaattcatttaattgtgactgtaaactgaaatggctagtggaatggcttggccacaccaatgcaactgttgaagacatctactgcgaaggccccccagaatacaagaagcgcaaaatcaatagtctctcctcgaaggattttgattgcatcattacagaatttgcaaagtctcaagacctgccttatcaatcattgtccatagacactttttcttatttgaatgatgagtatgtagtcatcgctcagccttttactggaaaatgcattttccttgaatgggaccatgtggaaaagaccttccggaattatgacaacattacaggcacatccactgtagtatgcaagcctatagtcattgaaactcagctctatgttattgtggcccagctgtttggtggctctcacatctataagcgagacagttttgcaaataaattcataaaaatccaggatattgaaattctcaaaatccgaaaacccaatgacattgaaacattcaagattgaaaacaactggtactttgttgttgctgacagttcaaaagctggttttactaccatttacaaatggaacggaaacggattctactcccatcaatccttacacgcgtggtacagggacactgatgtggaatatctagaaatagtcagaacacctcagacactcagaacgcctcatttaattctgtctagtagttcccagcgtcctgtaatttatcagtggaacaaagcaacacaattattcactaaccaaactgacattcctaacatggaggatgtgtacgcagtgaagcacttctcagtgaaaggggacgtgtacatttgcttgacaagattcattggtgattccaaagtcatgaaatggggaggctcctcgttccaggatattcagaggatgccatcgcgaggatccatggtgttccagcctcttcaaataaataattaccaatatgcaattcttggaagtgattactcctttactcaagtgtataactgggatgcagagaaagccaaatttgtgaaatttcaggaattaaatgttcaggcaccaagatcattcacacatgtgtccattaataagcgtaattttctttttgcttccagttttaagggaaatacacagatttacaaacatgtcatagttgacttaagcgcatgagacaccaaattctgtggctgccatcagaaattttctacagtacatgacccggatgaactcaatgcatgatgactcttcttatcacacttgcaaatgaatgcctttcaaacattgagactgctagaaccaagcactaccagtatctccatccttaactgtccagtccagtgatgtgggaagttaccttttataagacaaaatttaattgtgtaactgttctttgcagtgaagatgtgtaaataagcgtttaatggtatctgttactccaaaaagaaatattaatatgtacttttccatttatttattcatgtgtacagaaacaactgccaaataaaatgtttacattttctttcatatcccagaggtaatta

SEQ ID NO: 148450 - DNA, 4572 bp, Homo sapiens
  Payload ID: 9401
  Gene Symbol: LZTR1
  Gene Name: leucine-zipper-like transcription regulator 1
  Uniprot ID: Q8N653
  ENST ID: ENST00000215739
  CDS Start-End: 360-2882
ggccgcgggtcttcgggctgcgtgggcctgggaggcgccgggaagagcagtcgcgacggggctagggacgacacactgcattcactggaagggacaacgcagcgccagtacatagcctgaaacgctccccagaaggtcccacgctcgccgcgcggtcgacaaccgcatcctgcgctcgcccgcggtgtctcggcaagcggtaggcttgtcgggaagagctggagggcgcaagtgcggcgctggccggacgtgccgcaccgtcagcgcagggctcgccgggaaatgtggtttctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggcgcagcaagcacacagtggtggcctataaagatgccatttatgtatttggtggagacaatgggaagaccatgctcaatgacctcctgcggttcgatgtgaaagactgctcctggtgcagggcctttaccactgggaccccaccggccccccgttaccaccactcggccgtcgtctatgggagcagcatgtttgtctttgggggttacactggggacatttattccaattctaacttgaagaataaaaacgacctctttgaatacaagtttgcaactggccagtggacggagtggaaaattgaaggacggttgccagtcgctaggtcagcccatggggccacggtgtacagtgacaagctgtggatctttgctggctatgacggcaacgccaggttgaatgacatgtggacaattggcctccaggaccgagagctcacctgctgggaggaggtggcccagagtggcgagatccccccatcttgctgcaacttccccgtggctgtgtgccgggacaagatgtttgtattctctgggcaaagcggagccaaaataaccaacaacctcttccagtttgaattcaaggacaagacgtggacacgcatcccaactgaacacctgctccggggctccccaccacccccgcagcggcgctacgggcataccatggtggcctttgaccgccacctctatgtgtttgggggtgcggccgacaacacgctgcccaacgagctgcactgctatgacgtggacttccagacctgggaggtcgtccagcccagctccgacagcgaggttggtggggctgaagtgcccgagcgagcctgtgcttccgaggaggtgcccaccctgacctatgaggagcgggttggcttcaagaagtcccgagatgtgtttggcctggactttggcaccacctcagccaagcagcccacccagcctgcctcggagctgcccagtgggaggctcttccacgcggctgctgtcatctcggacgccatgtacatcttcgggggcacggtggacaacaacatccgcagcggggagatgtacaggttccagttctcctgttaccctaaatgcacgctgcacgaggactacgggcggctgtgggagagccgccagttctgcgacgtggagttcgtgctgggtgagaaggaggagtgcgtgcagggccacgtagccattgtcacagcgcggagccgctggcttcgcaggaagatcacgcaggcgcgggagaggctggcccagaagctggagcaggaggccgccccagttcccagggaggcccccggcgtggctgctggtggggcccggccgcccctgctgcacgtggccatccgggaggccgaggcccggcccttcgaggtgctcatgcagttcctctacaccgacaagatcaaatacccacggaaaggccatgtggaggatgtgctgctcatcatggatgtgtacaaactggcactgagcttccagttgtgccgcctggagcagctgtgccgccagtacatcgaggcctccgtggacctgcagaacgtgctggttgtgtgcgagagtgccgcccggctgcagctgagccaactcaaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggcacatctctgatccaggacatgaaggcatacctggagggagcgggcgcggaattctgtgacatcactctgttgcttgacgggcacccacggccagcccacaaggctatcctggccgcccgctccagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctctacttgtttgcggccccctactactacggcttctacaacaaccggctgcaggcgtactgcaagcagaacctggagatgaacgtgacggtgcagaacgtgctgcagatcctggaggcagctgacaaaacgcaggcactggacatgaagcggcactgcctgcacatcattgtgcaccagttcaccaaggtctccaagttgcccaccctgcggtcgctgagccagcagctgctgctggacatcatagactccctggcctcccacatctcagacaagcagtgcgcagagctgggcgccgacatctgaggccctgtggcgcctgcccattgtgaagaatcgccgtgcctgcctgccctgcctactgagaagactaccggctatgcgcatgcctatggcagtgggtgcacctgccaggccaagggtcagggtgcccagagcctccaaagagagctgaggggatgtggggccccaaactcattaattcactgaagacacaggtcccacagggagcggatgatgaagcagaccccctcctgtcatcaccctctcctggtgtagtgtggatgcgaggccacggctcagtgatgggctcaccacccagaagtggggagagactttgggcctcccacccagtggggcttggcctggcttctgtggcctgggcgtgttgtggactcaggcactggggcctgtcaccaaggctcctccaacatgcgggaggaggcttagcagacttgcgctgcaccagcgaatctgcctgggctgctcctgtcccacccaccctcactgagatccatgtaaggggctcctcttcccacctggaacttgtgagtggggacccatgatgtatgggtctcacctgacttgaggtgaattttggagtgaagggccctgaggtcagctcccaggtcggtcgtgctgggccaggcctggttttcacaggggctgaaggatcccagtccacctgtgtgcatgtcagggctcggccgggaagaagccagcaaagtcccccgtgtcccttgctgagtattctgtcacagacaagcctccattaaagccacagcagtgctacccaccacacacaccttgctggcccggccaccactgctggcttcagccccttgagcagcccatggcttagcagacccccagatgtaggtcagtggccttacctgtctctatccatgctgtcaactcctgcctccacctggggtcacccagtcacattgggaagggctgtgaaggcctccaggctggccccttccaggggaatcctggaggcctggggtgggctcctgccccttctgccctgccttgcccctgcactatgctcttggctcctgtggaaggagggctgccctcttgccctagtgagggccccatgtggatccactctagtgctgggagccagcgctcccttactgggaacaggattccaggacccctttcttgttgtggctgccatgaagccacagctccttggggaagtgacctgctctcctttgggtgtatgcaggtgtgtggggggccctgagtggcaagttgcttagctaacaggagatccataggcagcctgcaggctaggaagtggcctagtgcaagatgagctgggaacaagggaggagagagcaggagctggggcagaggctgagccgggaggcccttgaggtgaggacacagcaggcccaggaccatggctggggaggatatgtcagcacctggaagtggagtgcaggctgcagcgcccagccatgtgggccaggtgcattcactcagagtggggccacacacccatctacccagtttccacaagatgtggctcctgccacacccacagggcagcctcctccaaatccctcctggaggggcctacccagaagcctccttgaaccagtctgcaaccctgctctatgctgacccttgtcactgaaccctgatctagacttatatgaataaatgaaattacatgccaagggccctaaaaagcaaattttac

SEQ ID NO: 148451 - DNA, 635 bp, Homo sapiens
  Payload ID: 9401
  Gene Symbol: LZTR1
  Gene Name: leucine-zipper-like transcription regulator 1
  ENST ID: ENST00000439171
  CDS Start-End: 1-334
cgtggacctgcagaacgtgctggttgtgtgcgagagtgccgcccggctgcagctgagccaactcaaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggccccttcattcccccagctctccctggggcttgtgctgaccccggttgctggctcttggtgatgtctgcaggcaccagaggccatgcagtgggcctggagggggcttgatcatgaggcacatctctgatccaggacatgaaggcatacctggagggagcgggcgcggaattctgtgacatcactctgttgcttgacgggcacccacggccagcccacaaggctatcctggccgcccgctccagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctctacttgtttgcggccc

SEQ ID NO: 148452 - DNA, 648 bp, Homo sapiens
  Payload ID: 9401
  Gene Symbol: LZTR1
  Gene Name: leucine-zipper-like transcription regulator 1
  ENST ID: ENST00000415354
  CDS Start-End: 1-294
atgcagttcctctacaccgacaagatcaaatacccacggaaagaacgtgctggttgtgtgcgagagtgccgcccggctgcagctgagccaactcaaggagcactgcctgaacttcgtggtaaaggagtcccacttcaaccaggtgatcatgatgaaggagttcgagcgcctctcctctccactgatagtggagattgtgcggcggaagcagcagccgccccctcgcactcccttggaccagccagtggacattggccccttcattcccccagctctccctggggcttgtgctgaccccggttgctggctcttggtgatgtctgcaggcaccagaggccatgcagtgggcctggagggggcttgatcatgaggcacatctctgatccaggacatgaaggcatacctggagggagcgggcgcggaattctgtgacatcactctgttgcttgacgggcacccacggccagcccacaaggctatcctggccgcccgctccagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgct

SEQ ID NO: 148453 - DNA, 872 bp, Homo sapiens
  Payload ID: 9401
  Gene Symbol: LZTR1
  Gene Name: leucine-zipper-like transcription regulator 1
  ENST ID: ENST00000414985
  CDS Start-End: 104-457
accgtcagcgcagggctcgccgggaaatgtggtttctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggcgcagcaagcacacagtggtggcctataaagatgccatttatgtatttggtggagacaatgggaagaccatgctcaatgacctcctgcggttcgatgtgaaagactgctcctggtgcagggggttacactggggacatttattccaattctaacttgaagaataaaaacgacctctttgaatacaagtttgcaactggccagtggacggagtggaaaattgaaggacggttgccagtcgctaggtcagcccatggggccacggtgtacagtgacaagctgtggatctttgctggctatgacggcaacgccaggttgaatgacatgtggacaattggcctccaggaccgagagctcacctgctgggaggaggtggcccagagtggcgagatccccccatcttgctgcaacttccccgtggctgtgtgccgggacaagatgtttgtattctctgggcaaagcggagccaaaataaccaacaacctcttccagtttgaattcaaggacaagacgtggacacgcatcccaactgaacacctgctccggggctccccaccacccccgcagcgg

SEQ ID NO: 148454 - DNA, 2323 bp, Homo sapiens
  Payload ID: 9401
  Gene Symbol: LZTR1
  Gene Name: leucine-zipper-like transcription regulator 1
  ENST ID: ENST00000415817
  CDS Start-End: 1-475
cgaagatgggcaggtgaacatctccatcggggagatggtgcccagcaggcaggccttcgagtccatgctgcgctacatctactacggcgaggtcaacatgccgcccgaggactcgctctacttgtttgcggccccctactactacggcttctacaacaaccggctgcaggcgtactgcaagcagaacctggagatgaacgtgacggtgcagaacgtgctgcagatcctggaggcagctgacaaaacgcaggcactggacatgaagcggcactgcctgcacatcattgtgcaccagttcaccaaggtcagggctctggcctccccttcaggactcgcttccccttggcagtggccatgcccaggcagggagggtgcccaggctctgtggtcccctgcagtggtgggccctgggggtgagagaagcagagcagcccatcactggccgcaccttgcttcatccttgggaccagcctgagccctgagcagggtaggccccacagggctccactgcccaccatggcccttaggtggatctggtcccatctccttccggcctgcttgccttacaggtctccaagttgcccaccctgcggtcgctgagccagcagctgctgctggacatcatagactccctggcctcccacatctcagacaagcagtgcgcagagctgggcgccgacatctgaggccctgtggcgcctgcccattgtgaagaatcgccgtgcctgcctgccctgcctactgagaagactaccggctatgcgcatgcctatggcagtgggtgcacctgccaggccaagggtcagggtgcccagagcctccaaagagagctgaggggatgtggggccccaaactcattaattcactgaagacacaggtcccacagggagcggatgatgaagcagaccccctcctgtcatcaccctctcctggtgtagtgtggatgcgaggccacggctcagtgatgggctcaccacccagaagtggggagagactttgggcctcccacccagtggggcttggcctggcttctgtggcctgggcgtgttgtggactcaggcactggggcctgtcaccaaggctcctccaacatgcgggaggaggcttagcagacttgcgctgcaccagcgaatctgcctgggctgctcctgtcccacccaccctcactgagatccatgtaaggggctcctcttcccacctggaacttgtgagtggggacccatgatgtatgggtctcacctgacttgaggtgaattttggagtgaagggccctgaggtcagctcccaggtcggtcgtgctgggccaggcctggttttcacaggggctgaaggatcccagtccacctgtgtgcatgtcagggctcggccgggaagaagccagcaaagtcccccgtgtcccttgctgagtattctgtcacagacaagcctccattaaagccacagcagtgctacccaccacacacaccttgctggcccggccaccactgctggcttcagccccttgagcagcccatggcttagcagacccccagatgtaggtcagtggccttacctgtctctatccatgctgtcaactcctgcctccacctggggtcacccagtcacattgggaagggctgtgaaggcctccaggctggccccttccaggggaatcctggaggcctggggtgggctcctgccccttctgccctgccttgcccctgcactatgctcttggctcctgtggaaggagggctgccctcttgccctagtgagggccccatgtggatccactctagtgctgggagccagcgctcccttactgggaacaggattccaggacccctttcttgttgtggctgccatgaagccacagctccttggggaagtgacctgctctcctttgggtgtatgcaggtgtgtggggggccctgagtggcaagttgcttagctaacaggagatccataggcagcctgcaggctaggaagtggcctagtgcaagatgagctgggaacaagggaggagagagcaggagctggggcagaggctgagccgggaggcccttgaggtgaggacacagcaggcccaggaccatggctggggaggatatgtcagcacctggaagtggagtgcaggctgcagcgcccagccatgtgggccaggtgcattcactcagagtggggccacacacccatctacccagtttccacaagatgtggctcctgccacacccacagggcagcctcctccaaatccctcctggaggggcctacccagaagcctccttgaaccagtctgcaaccctgctctatgctgacccttgtcactgaaccctgatctaga

SEQ ID NO: 148455 - DNA, 698 bp, Homo sapiens
  Payload ID: 9401
  Gene Symbol: LZTR1
  Gene Name: leucine-zipper-like transcription regulator 1
  ENST ID: ENST00000443265
  CDS Start-End: 50-355
gtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagtgcatcgctggcggcgcctcccgccctgcgacgagttcgtgggtgcccggtacggcgcagcaagcacacagtggtggcctataaagatgccatttatgtatttggtggagacaatgggaagaccatgctcaatgacctcctgcggttcgatgtgaaagactgctcctggtgcagggcctttaccactgggaccccaccggccccccgttaccaccactcggccgtcgtctatgggagcagcatgtttgtctttgggggttacactggggacatttattccaattctaacttgaagaataaaaacgacctctttgaatacaagtttgcaactggccagtggacggagtggaaaattgaaggacggttgccagtcgctaggtcagcccatggggccacggtgtacagtgacaagctgtggatctttgctggctatgacggcaacgccaggttgaatgacatgtggacaattggcctccaggaccgagagctcacctgctg

SEQ ID NO: 148456 - DNA, 878 bp, Homo sapiens
  Payload ID: 9401
  Gene Symbol: LZTR1
  Gene Name: leucine-zipper-like transcription regulator 1
  ENST ID: ENST00000452988
  CDS Start-End: 1-165
ttcaaccaggtgatcatgatgaaggagttcgagcgcctctcctctccactgatagtggagattgtgcggcggaagcagcagccgccccctcgcactcccttggaccagccagtggacattggacatgaaggcatacctggagggagcgggcgcggaattctgtgacatcactctgttgcttgacgggcacccacggccagcccacaaggctatcctggccgcccgctccagctactttgaagccatgttccggtccttcatgcccgaagatgggcaggtgaacatctccatcggggagatggtgcccagcaggcaggccttcgagtccatgctgcgctacatctactacggcgaggtcaacatgccgcccgaggactcgctctacttgtttgcggccccctactactacggcttctacaacaaccggctgcaggcgtactgcaagcagaacctggagatgaacgtgacggtgcagaacgtgctgcagatcctggaggcagctgacaaaacgcaggcactggacatgaagcggcactgcctgcacatcattgtgcaccagttcaccaaggtctccaagttgcccaccctgcggtcgctgagccagcagctgctgctggacatcatagactccctggcctcccacatctcagacaagcagtgcgcagagctgggcgccgacatctgaggccctgtggcgcctgcccattgtgaagaatcgccgtgcctgcctgccctgcctactgagaagactaccggctatgcgcatgcctatggcagtgggtgcacctgccaggccaagggtcagggtgcccagagcctccaaagagagctgaggggatgtggggccccaaactcattaattcactgaagacacaggt

SEQ ID NO: 148457 - DNA, 12752 bp, Homo sapiens
  Payload ID: 9402
  Gene Symbol: LNPEP
  Gene Name: leucyl/cystinyl aminopeptidase
  Uniprot ID: Q9UIQ6
  ENST ID: ENST00000231368
  CDS Start-End: 693-3770
tccgcggccaacctccccagggaaaccagcgattcgcggttcagatagcgaccttcgcccgcaggttcctgctctgccttcagacttcggcttcagtggcacctgctcagcgaggcctcgtctaaccaagccatccgaattaactacccactcactcgccatcacatcaccccgatttaattcgcagcggggcactgactttacactcgtgtgtcttctgtgtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccacggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatgatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaagattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggttaatgaaaagtagcctgaatggagataacttccgaacacagaagctgtcttttatcattagaacagtgggtcgacattttcctggacacttactggcatgggattttgtcaaagagaactggaataagcttgtacagaagttccctctggggtcctataccatacaaaatattgttgctggatcaacttacctgttttcaacaaagacacatttatctgaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactgacctcaggtgtgcagatctactttgatttggggttttgattaattctttatttttctgaaaaaaagtttaaataatgtctgtaactattgtgtttttttcctgccgaatagccaggtgctacagatttttaaaatttttgttgtattgaaaagctaaacaaggccaaaaggttaaattttttgaatatttaagactttctttttcatcttttatagcgttaccataggaaactgttccaaactgagttagctttaattataattattttattcataaatggtgatagtccccagatctgtacacctttatcactccctgccgtagatatactttaggttagtatttctacattcgtggcaagcattttggtaacaccagtggttttcattgtgacttttatcactatcactaagaatgcaatttaagttgccttttggcatcatagatcatagaaactttctctctgaatcatacccatgtgtgaattttcattttatatgatagtgtagcatattagaagcatattttaaaacagagcctttgagaaattgaaaaacaattatttgaagttcaccatagtaccttaaaggaacaaagagaatgtgggataggagtaacttgaattcgtgtttagtatggtgggctttgaatttttttcactatcaaaaatagtgcttttgtttagttaaaaattgtagtttttctttttttgtgtgtccaaactaacataaaaggagtggtcaaagaaggaaagaagaaaaatgagggaggatgtccgaaactgtatggcattttactccttctgaaagagaaatactgtacttgaatttttgagctatgcagacttatacctagattgttgtgtttctttgattcttaggagaaaagctttcttcctaataattcttgagaactttatattttgtttgaaaacagtttctatgtacataaaaagggtatttacccatttgtgagcacttaaaacactccacagagtcagacagtgggaaaggtcaccctttttttattcggcaggtatcaagttagaatgtatggaattgtgaataaaattatattttattttatgaaaatatttttatataataaaatttaaaaggctggtaagctaaaaaaatagtcttctttaatcctagtgtgttttccccaatttagtcttttctaaaatttatctgttttagagtagaaaatattatatcctgagaatcacagaatcatctaaatatgtcttattcaactgaagtgattgtaagtctttattcttgtgctttggttaaatgaatgataatttagttgatagtgaaagttaatgtgtttttatatttttagagtgagggaaaaatactaaacttttgagagttttgttgtcgttgctggttttttaccatgtggtactaaattccactttgatacaaaatttaaattttgtaacttctcaaaatcacttaagattcttcagttttacctgtgcttcttgacatcgctcctataatgtatgttagttaactctgcatatggcaaatcttgtcttgaattatatcatttctctccctctctctctctctctgtgtgtgtgtgtgtgtgtgtgtgtgtgtgtgtgtgtgtgtgtgtgtgtagtgtggggggtattgttatgagtaaaactttatcaaaacttggcctgaaaaagagataactcatgatccattgctatctttattactcaaaggctgttcattcccataataccagatccataatagttgtagtttttttgatgttgttgcccttaccttaattatttgtagttttagtaggccttgcctcagtttttcccacagaattccataattttaatgttgaactaacccatctatataggacttctaaaaactacgtcaggaatgtaaggttaaatgagaggtagaacttgtagtgtaataggtataatggtagctttcaaagttttatcttctcaaaacattgtcttagccagtgtatttctgagaactcagactgaagcacagaagtcacagtatgcttcttttatttaagcacacagattcatgacacaagtacttgttgaacaagtgttctcattgcagagagatctacttgaatataaaagggtcatcatactagattattaaaaaagaattggaaatcttgagttgtggaagaaatgtttatgctttggagatctaaaaaagttatgaatgtaggaattagataagtccagtttgttctgttaatataaaatggttagatatattaaactgcaagtagtatcagcttcaccataagcttgggccttcctccatcttgttttatttaagtctctttaaatgaaattttgttgtcattgtttcagcattcatgaactttcttactatcacaggttctactttaattttccttgccatatgtgtttccattttgtgggacattagccaccacaggaacacaagagttgtcagaagactcctgggtgtacagagcaaatcaagctgcatcagtattataggataccaaacagaatcctttctattaggaaataagaaatcagttaagtgttggctgggcgcggtggcttatgcctgtaatcccagcattttgggatgccaaggtgggcagaccatttgaggccaggagttctaaaccagtttggccgacatggcaaaaccccatctctactaaaaatataaaaattagctgggcatggtggtgcacacctgtaatcccagctacctgggaggcacgagaatcacttgaacccaggaggcggaggttgcagtgagccaaggttgtgccactgcactccagcctgggtgacaaagcgagactgtctcaaaaaacaaaaaacaaaaaaaaaagagttaagtgttgattttgttggattactgacagtttgttgagatggattttaaaaagagtctatttaaaccaaagtacctggaaccataatctgccatcagattgctaaacattcacataatccccatgtttcatggggcttcagggaaggcaaatacatctgagatgagccacctccaaggacagcatttcctgggctgcaaaactagatgtggattttgttacttaggcctctctaaaaactgaggccatggatatgacatagcttttcttctcacctatgcctttgttacttttgtatttattggaattaaatctctttttaaagagcttccttcccccttcatcccatttgtatttttaaaaactaagttatatatatatttgcttgtttttgcattcttttattttgtgctccattccctgctttgccagttaagtactacctgaaaagtagcggttcaaaagtatggtaaatctcctcccttaaccttattgcctgtgtgggtgacagctaatggaaaagttgatcgatttttttcagtggtttttttgggagtatatactttaaaaatgtacatacatgtttttgatagtttttatattatttcattttgtatatttttttcctgatgaagagtgatatatcatcctatgaaaatttcatctacccttcccattttacctgtatgggcagtagctacagactagttatttggtttccttctttggaagaaggtggtgatgttgagaggagagcaagctatattcttttaaaagtgtgtacagatgtttttgctattttgtgttatttcattttgtatttcattcatccattttgtggacgtgtagataaaacgcggtggtccaaaagcatgacagatgtcccctttgcgtttctccttattgttcgcatggacaataactgacagagtagtcctagttgctgttgttttgatctagtcttggggctggggttgtatattattctttcaagtgtgtataaatattgtgccacctttttatacttcattttatacttgtttccttgtatggatgcatatatacttaatgaaaattgaggttcagagtatgacaaatctcttttcccttttccttactgcctatttaggcaatagctaatagagtagtttgttttgttttggggtgtgggggagagtggagtatgtacttaatgtatataaataaacttgctactacattgtattactaatttggttcacactgtgtccttctcatggatgtgaaagtaccaatgaaatgtggagatctcgatgtataacagtctcccattctcctcatcccttattgactgctgggcagtagctaacagagtagttgtcaagtggcgtatttgaggtgagggggagggacggggaaggtaggaaaatgcacttaatgtatatacatgtttttactactacattgtattaattcatcgggtgcccagactgaaaggtacctaatgaaccatggagttccggatgtataacagtctcctcttttccctttcccttattgcccatgtgggcaatacttaagagtagtttgggtttattgaagattttttgctaggagagagaaaattttttgctaggagaggtttcaaggtaagagtatatactttaaacatgtatataaatgtttttgctacttttctgtcactacctttcttaccttgtcctttacatggatatatgaagaaaattgaggttcagcctgtagcagctctcctcttctgcccttcccttagattgtctgtgtgggcaggtgtctaagagagtagttgattagcttcagggattctttggtgggtgttggggtatatacttttgtatatgtatgtacatatttttatttctttattatagtgtttcattgggtacccggtccttcacttggatgtgtaggttcctaatgagccatggagttatggatgtataacaatctgttctccctttacccttttaatgtatatgggcaataattttaaagtagtttggatttttttaagttttgaggggtgggaggggtctaaggcagaatatatcctttttaaaaatgtatatatacttttcattaactatattgtattatttcatgctgtacccagtccattgcttggacttacgggtacctaatgaaacgtggaggtccggatgtatgaaaatctcctcttttcccctttccttattgcctctgtaggcaataattatagagtagtatagatggtttttcttttttatccatctgcctatctccaggaggatggggtgtgcacttttagaaatgtatataaatgttcttgctcctttttcctgttacttcattgtgtgccaaggcctttccatggatacttaggtacgtaatgaaaattgaggttcattctatgaaaaaatctccccttctccccttcccttattgcctgtcttggcaatggccagtagagtagttatttaagggattttgtttttttgtttttttgttttttttttggtaggggaggtggggaatttctgggtttgtcttttttttaatgtatataaaagtttgctagttgttgttattgttgttctttcactctcaacacagttttttgtttggagttgtaggaatcaaatgtaatgagggacccagacccgagagtgtggtaaatattctttgccttcctcagagcctgtatacacaagcaagtagtatgtgagcactacagggcttgggttttggttttttgcttttgagggttttaatgaggagtgggattgttgagaggaaaaggcaagatatataatttttttaatgtatataaatgttttgctcctttttgatgttaacttcattttgaatctggtcctttgtatgaccacttaggtacttaatagtaataaagttgagattgactctatgaaaaatatcccatactccccatccctcattgcctagggggcaatggtagaatagatgtttggtttcttttgggggtgtctgagtgtatatgtgtgtgtatatacacacaagaacacacatatttatatactatacacacacattttaatgtatataaatatttgctacattctgtgtgttatataatgtggtacccagtcctctgctgggacatggatgtacataatgaaacatggaggtccagacgtatgataactctcctgtttcccttccctcattgcctacaggggcaatagtttcatatcttgggttttttattgtttaatttttttttatggggaggggttctttgggtgggtaatagtcagggggaaaggacagtgtctatactttttaaagatgtatataaatgtttcatgttattggttttgtacctagtcctttgcatggatatataggtacctaatgaaaatcgaggatcagtgtatgacaaatctcccatcctcccctttccttattgcctgtgtcggcaataggaagtagaatagttgtgtgttgtttacttacttgtctgttttagagagatttctatttttggtaggggaatattcttaatatgttttcatatctttatttcattttgtagtcttttgcatggctatgtagggacctaatgaaagtcgagtttcataatatgacagctcacttcttttcctacatatttcctcacttagcagtagctagtgtagttattttgtggttattttatttcattctctaggatctattccattaaggatgcaagtgtgtagatgcatatatatcatttgcttctttcttccgccattattttcctttaacacttagtcccttgcaaggggtctgactatacctaacaaaaataaagacctactaaatccctgccatctggctggaaggtgtagcagtgtattaatgtaactaatagcaacaggtgtgcagcagataagacaggagaagacactcagctatggttgagttgtgaaagctaattagatccagcatttcttatgttgattcagattgaatgaggtagtgaaaagggacctgtgcttttgtaaattctagaaaggcaagaggacaatattgaataaagctgtgtttaaacttcattgctcatatatcttttagtaactggtaaaccggcgaagctgataagccaataagagtgctgtctagaacgcatttgcaaaccgttaagagtagcttctttttgaggcctggacttctgattcatctatagaagtctattatgattccatcaattgcatagcttgtgtacctggtagaaattgtgtcttggaatgaccctttcgagttattgacatggctctgatgaatagaacatgagccccaaaactaaatccaaaaggaattttctatctttcatcccccacatgtggcaagacaagttggccctttcttacccagaggtcttttgtgtgactgcatctttctcctccgttctccattgtgtgctttccattttgtctttagtgcctatactgttaggtgttttcttcactggcattcacaaatttaagccattgctgcctcattagccttgtattttgtgtgcatatcatgtatccagacctgtatgttcgctttaagcattcttatatcacactgtctcctcatctaccatatggtaaatgttaaaactccacatttgtctgcatcagggaaaatgcatgggcacacatcctccctccctccctctctgctctcctcccttccttcaggcctcttagcattgtttgttttcccatttctgatactactactccatgctgaagatttgccatattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaatacaaaca

SEQ ID NO: 148458 - DNA, 3888 bp, Homo sapiens
  Payload ID: 9402
  Gene Symbol: LNPEP
  Gene Name: leucyl/cystinyl aminopeptidase
  Uniprot ID: Q9UIQ6
  ENST ID: ENST00000395770
  CDS Start-End: 350-3385
gctcctaactccactaagtacagaagtggagccgtacagccatgaatgtcaggcatgttgtggggactagttgtattagttttctattgccaccataacaaattaccacaaacttaagcaatatagtacaaatttatcttaaagttattggcaggtcagaagcctgatacggatctcattgggctaaaacgaaggagttggcagggctgtgtgttcctttctgtaggctctgggcaggatccatttcctgcacttttttggcttttggaggtcgtccacattccttggctcctggccctgctccttcatcttcaaagctaccaaagatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaagattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggttaatgaaaagtagcctgaatggagataacttccgaacacagaagctgtcttttatcattagaacagtgggtcgacattttcctggacacttactggcatgggattttgtcaaagagaactggaataagcttgtacagaagttccctctggggtcctataccatacaaaatattgttgctggatcaacttacctgttttcaacaaagacacatttatctgaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactga

SEQ ID NO: 148459 - DNA, 2213 bp, Homo sapiens
  Payload ID: 9403
  Gene Symbol: LARS
  Gene Name: leucyl-tRNA synthetase
  Uniprot ID: Q9P2J5
  ENST ID: ENST00000274562
  CDS Start-End: 546-2003
cgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttctttgggtgtccaaga

SEQ ID NO: 148460 - DNA, 4766 bp, Homo sapiens
  Payload ID: 9403
  Gene Symbol: LARS
  Gene Name: leucyl-tRNA synthetase
  Uniprot ID: Q9P2J5
  ENST ID: ENST00000394434
  CDS Start-End: 168-3698
ggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttctttgggtgtccaagagaaatggtttttgccaaactctttttaaaaaacaaattgttgctatttcctagaagtttctggtttttaagatgaacataaaagtgtcagtatgcttcttttatgaggtgtactttatactttgatgaaggctaaggtgtacctaacagctttttatagtatattcatttatggagttagctgtatttttttttaaaaaagaaaagtagtaaattagcagcttttttttttaaatgaagagaacttcatgatgatttaaaagaactaatgagaatattttgacttgacttcaattactaagtattttgtataaagaacaaataggtcctgcattttataagactttttaaagctttaattattcaactaagaaccaataatggcttcttcaaggctaatatcaatagtttataagcagtatatttcacctacactaaatatgggcattttaaaagaagattccccccttcccccccagaaatctgcatttactaaatttgtcttaagtccaattgtgtttaaaggtcatgctggtcgggtgtggtggctcacacctataatcccagcactttgggaggccaaggtgggcagtcacctgaggtcaggagtttgagaccagcctgaccaacatggtgaaaccccgtctctactaaaaatacaaaaattagcttggcatggtggcgggtacctgtaatcccagctgcttgggagtgtgaggcaggagaatcgcttgaacctgggagaccgaggttgcagtgagctgaaaccgtgccattgcactccagcttaggcaacaagagtgaaactctgtctcaatcaatccatcaatcaatcaataaaatagaggtcatgctgact

SEQ ID NO: 148461 - DNA, 3737 bp, Homo sapiens
  Payload ID: 9403
  Gene Symbol: LARS
  Gene Name: leucyl-tRNA synthetase
  Uniprot ID: Q9P2J5
  ENST ID: ENST00000510191
  CDS Start-End: 174-3542
aggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcgcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctgctaaagctggatcttctaaataccagtggggcattatgaaatcccttggcctgtctgatgaagagatagtaaaattttctgaagcagaacattggcttgattatttcccgccactggctattcaggatttaaaaagaatgggtttgaaggtagactggcgtcgttccttcatcaccactgatgttaatccttactatgattcatttgtcagatggcaatttttaacattaagagaaagaaacaaaattaaatttgggaagcggtatacaatttactctccgaaagatggacagccttgcatggatcatgatagacaaactggagagggtgttggacctcaggaatatactttactcaaattgaaggtgcttgagccatacccatctaaattaagtggcctgaaaggtaaaaatattttcttggtggctgctactctcagacctgagaccatgtttgggcagacaaattgttgggttcgtcctgatatgaagtacattggatttgagacggtgaatggtgatatattcatctgtacccaaaaagcagccaggaatatgtcataccagggctttaccaaagacaatggcgtggtgcctgttgttaaggaattaatgggggaggaaattcttggtgcatcactttctgcacctttaacatcatacaaggtgatctatgttctcccaatgctaactattaaggaggataaaggcactggtgtggttacaagtgttccttccgactcccctgatgatattgctgccctcagagacttgaagaaaaagcaagccttacgagcaaaatatggaattagagatgacatggtcttgccatttgagccggtgccagtcattgaaatcccaggttttggaaatctttctgctgtaaccatttgtgatgagttgaaaattcagagccagaatgaccgggaaaaacttgcagaagcaaaggagaagatatatctaaaaggattttatgagggtatcatgttggtggatggatttaaaggacagaaggttcaagatgtaaagaagactattcagaaaaagatgattgacgctggagatgcacttatttacatggaaccagagaaacaagtgatgtccaggtcgtcagatgaatgtgttgtggctctgtgtgaccagtggtacttggattatggagaagagaattggaagaaacagacatctcagtgcttgaagaacctggaaacattctgtgaggagaccaggaggaattttgaagccaccttaggttggctacaagaacatgcttgctcaagaacttatggtctaggcactcacctgccttgggatgagcagtggctgattgaatcactttctgactccactatttacatggcattttacacagttgcacacctattgcaggggggtaacttgcatggacaggcagagtctccgctgggcattagaccgcaacagatgaccaaggaagtttgggattatgttttcttcaaggaggctccatttcctaagactcagattgcaaaggaaaaattagatcagttaaagcaggagtttgaattctggtatcctgttgatcttcgcgtctctggcaaggatcttgttccaaatcatctttcatattacctttataatcatgtggctatgtggccggaacaaagtgacaaatggcctacagctgtgagagcaaatggacatctcctcctgaactctgagaagatgtcaaaatccacaggcaacttcctcactttgacccaagctattgacaaattttcagcagatggaatgcgtttggctctggctgatgctggtgacactgtagaagatgccaactttgtggaagccatggcagatgcaggtattctccgtctgtacacctgggtagagtgggtgaaagaaatggttgccaactgggacagcctaagaagtggtcctgccagcactttcaatgatagagtttttgccagtgaattgaatgcaggaattataaaaacagatcaaaactatgaaaagatgatgtttaaagaagctttgaaaacagggttttttgagtttcaggccgcaaaagataagtaccgtgaattggctgtggaagggatgcacagagaacttgtgttccggtttattgaagttcagacacttctcctcgctccattctgtccacatttgtgtgagcacatctggacactcctgggaaagcctgactcaattatgaatgcttcatggcctgtggcaggtcctgttaatgaagttttaatacactcctcacagtatcttatggaagtaacacatgaccttagactacgactcaagaactatatgatgccagctaaagggaagaagactgacaaacaacccctgcagaagccctcacattgcaccatctatgtggcaaagaactatccaccttggcaacataccaccctgtctgttctacgtaaacactttgaggccaataacggaaaactgcctgacaacaaagtcattgctagtgaactaggcagtatgccagaactgaagaaatacatgaagaaagtcatgccatttgttgccatgattaaggaaaatctggagaagatggggcctcgtattctggatttgcaattagaatttgatgaaaaggctgtgcttatggagaatatagtctatctgactaattcgcttgagctagaacacatagaagtcaagtttgcctccgaagcagaagataaaatcagggaagactgctgtcctgggaaaccacttaatgtttttagaatagaacctggtgtgtccgtttctctggtgaatccccagccatccaatggccacttctcaaccaaaattgaaatcaggcaaggagataactgtgattccataatcaggcgtttaatgaaaatgaatcgaggaattaaagacctttccaaagtgaaactgatgagatttgatgatccactgttggggcctcgacgagttcctgtcctgggaaaggagtacaccgagaagacccccatttctgagcatgctgttttcaatgtggacctcatgagcaagaaaattcatctgactgagaatgggataagggtggatattggcgatacaataatctatctggttcattaaactcatgcacattggagatttatcctggtttcttaggaatactactactctgattgtgtctactgattggctatcagaaccttaggctggacctaaatagattgatttcatttctaaccatccaattctgcatgtattcataattctatcaagtcatctttgattcctggacctaataaattttttttccctttc

SEQ ID NO: 148462 - DNA, 720 bp, Homo sapiens
  Payload ID: 9403
  Gene Symbol: LARS
  Gene Name: leucyl-tRNA synthetase
  ENST ID: ENST00000618084
  CDS Start-End: 133-615
gcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatgtgagtttgctgtagggtaccagcgattgaaaggaaaatgttgtctgtttccctttggcctgcactgtactggaatgcctattaaggcatgtgctgataagttgaaaagagaaatagagctgtatggttgcccccctgattttccagatgaagaagaggaagaggaagaaaccagtgttaaaacagaagatataataattaaggataaagctaaaggaaaaaagagtaaagctgctctaaagctggatcttctaaataccagtggggcattatgaaatcccttggcctgtctgatgaagagatagtaaaattttctgaagcagaacattggcttgattatttcccgccactggctattcaggatttaaaaagaatgggtt

SEQ ID NO: 148463 - DNA, 4281 bp, Homo sapiens
  Payload ID: 9404
  Gene Symbol: LARS2
  Gene Name: leucyl-tRNA synthetase 2, mitochondrial
  Uniprot ID: Q15031
  ENST ID: ENST00000265537
  CDS Start-End: 263-2974
gttgctctcctcccttccccggtcccgcccccgtctgtctgtgtcgactgcggacgctatcgataaagttgctgttttgacaacatggcggcgcccatggtccgtggcccggcagtgctcgcctaaaggtggagaacgaggagtagaggagccgcaggccagagcctgtgagcagatccagacctacagataaaaaacattatttaatctatctgggatttactccggcttatgatttgagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgataaatcgaagccaaaattttacgtgctttccatgttcccttatccttctggtaagctgcacatgggccatgtgcgtgtctacaccatcagcgacaccatagcacggttccagaagatgagagggatgcaggtcatcaaccccatgggatgggatgcttttggattgcctgctgaaaatgccgcagtcgagaggaatctacatccacaaagttggacacaaagtaatattaaacacatgaggaaacagcttgatcgtctgggcctgtgtttcagctgggatagggaaataactacgtgtttgccagattactacaagtggactcagtatctctttattaaactgtatgaggctgggctggcctatcaaaaggaggccctggttaactgggacccagtggatcaaacagtgcttgccaatgagcaggtggatgaacatggctgttcatggcgttctggagcaaaggtggaacagaagtacctcagacaatggtttattaagacaaccgcttatgcaaaggccatgcaggacgcgttggcagaccttccagaatggtatggaataaaaggcatgcaagcccactggattggggactgtgtgggctgccacctggacttcacattaaaggttcatgggcaagccacgggcgaaaagctgactgcctatacggccacccctgaagccatttatggcacctcccacgtggccatctcgcccagccacagactcctacatgggcacagctctctgaaggaagccttgaggatggcccttgtccctggcaaagattgcctcacgcctgtaatggctgtgaacatgcttacccagcaggaggtccctgtcgttattttggccaaagctgacttggaaggctctctggattcaaaaataggaattcccagtactagctcagaggacaccatcttagcccaaaccctgggcctggcctactctgaagtcattgaaactttgccagatggcacagagagactgagcagctctgctgagttcacaggtatgacccggcaggatgcttttctagccctgactcagaaagcccgggggaagagagtgggtggagacgtgacaagtgataaactgaaagactggctgatttcacggcagcggtactggggcacaccaatccccattgtccactgcccagtctgtggccccacacctgtgcccctggaggacttgcctgtgaccctgcccaacatcgcgtctttcactggcaagggaggccccccactggccatggcttcagagtgggtgaactgctcctgcccaaggtgcaagggagcagccaagagagagacagacacgatggatacctttgttgattctgcttggtactacttcagatacactgaccctcataatccacacagcccttttaacacagcagtggccgattactggatgcctgtggatttgtacattggagggaaagaacatgccgtcatgcacttgttctatgcaagattctttagtcatttttgccatgatcaaaaaatggttaaacatagggagccttttcataagctgctggcccaaggccttatcaaggggcagacattccgcctaccatctggacagtatctacagagagaggaagtggatctcacaggttccgttcctgttcatgcaaaaacgaaagagaagttagaggtgacgtgggagaagatgagtaagtccaaacacaacggggtggacccagaggaagttgtggagcagtatgggatcgacacgattcggctctacatcctttttgctgcccctcctgagaaggatatcttgtgggatgtgaaaactgatgctctccctggggtgctgagatggcaacaacgactgtggaccttgacaactcggtttattgaggccagggcttctgggaagtctccccagcctcagctgctgagtaacaaggagaaagctgaggccaggaagctctgggagtacaagaactccgtcatctctcaggtgaccacccatttcacagaggacttctcactgaattctgcaatttctcagctgatgggactcagcaatgccctctcgcaagcctctcagagcgtcattctccacagccccgagtttgaggatgctttgtgtgccctgatggtaatggctgctccactggcccctcatgtaacctcagagatctgggcaggcctggcgctggtgccgaggaagctctgtgcccactacacttgggatgccagtgtgctgctccaggcatggcctgctgtggacccggagttcctgcagcagcctgaggttgtccagatggcagttctgatcaacaataaagcttgtggcaaaattcctgtgccccaacaagttgcccgggaccaggacaaagtccacgaatttgttcttcaaagcgagctgggtgtcaggcttttgcaaggacgaagcatcaagaagtccttcctttccccgagaactgccctcatcaacttcctggtgcaagattgacagccaggaggctgcagctaccacgagggcctctgaggaacctccttccaggcctgggatgagggggcgatgtctgctggcccaggggaagggaaaagacaaatgtcttgactgttgacctcggtcctgtggcagactgcagtcaacagtgtgcctctgtagtgtggcctggtgctggggtgaaggtgagctgggcaaaggagaaatatgagctactgaggagggggttggacatcctgcccctcaccccccacccacactgcaggtagaggaggccatctgatcccatgggaagccatcagagacactgctggtgggagcaggaaggagcagtgcccctcgagcagccaggaagcctgcggatctgggaaatggctctgccttaggcacttctcgggaatttgaggccagcctgaggaactgcaggactcaggtgcaatgtgccagccacttggaactgctaactgagcctccagatggtagtgaatggtctctttgccttcaggctggatgaggaagtcatttaggaaatgttcaaataaccaatatgtggaaatggacacagggatcttctgaagttgctttgaatcaaaaggcaggcagtgctggttcctctgcctgtgtccccaccactccccagctctgtcatgcaggcctgtcctccccaaccccagctggatgtgcctcccaggcctgctgtggttctgacacacaggatcccaggcaaggcaccacttcctcacatgaatgaggagcagcaagtcataaccactcccttgggtatacaatttgctgtgtagtgaagtggaaccaggctcaggctgctggtcccaacctcagagccccaccgcagcccagtagggatgcagcacgccccagagggctcatgtgggccccagatggcaatgccaccattgttgatgtgactccagagccagttattaggaagagcaagctcaccacagaggagtggaactgaggccccccagatgttgcctccggtgtccaagccacagcggtctggctgttgggaagatggccaggaatggactcataccattggcacattaggctaatcctggttttatgtgaagtcagcaattaagtgttcccactagaactgacctaagccactgattaatatttaatgagggaaggtaggggagaatctagccattttataatgccagaaatctatatatgttatctgatgccatttttctgaagtagcctcacatgtggtccccctgcagttcagcagttaacagatgacttttttagtgtaataaaatgtttatcatctatga

SEQ ID NO: 148464 - DNA, 566 bp, Homo sapiens
  Payload ID: 9404
  Gene Symbol: LARS2
  Gene Name: leucyl-tRNA synthetase 2, mitochondrial
  ENST ID: ENST00000430399
  CDS Start-End: 224-566
agtgctcgcctaaaggtggagaacgaggagtagaggagccgcaggccagagcctgtgagcaggtcgttttcacgttagggctcggaggtcctcagaaagatgaggttccagacgagaaatccgcctgaggtcacagatccagacctacagataaaaaacattatttaatctatctgggatttactccggcttatgatttgagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgataaatcgaagccaaaattttacgtgctttccatgttcccttatccttctggtaagctgcacatgggccatgtgcgtgtctacaccatcagcgacaccatagcacggttcc

SEQ ID NO: 148465 - DNA, 570 bp, Homo sapiens
  Payload ID: 9404
  Gene Symbol: LARS2
  Gene Name: leucyl-tRNA synthetase 2, mitochondrial
  ENST ID: ENST00000431023
  CDS Start-End: 139-570
atcgataaagttgctgttttgacaacatggcggcgcccatggtccgtggcccggcagtgctcgcctaaaggtggagaacgaggagtagaggagccgcaggccagagcctgtgagcagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgatgtcatcaaccccatgggatgggatgcttttggattgcctgctgaaaatgccgcagtcgagaggaatctacatccacaaagttggacacaaagtaatattaaacacatgaggaaacagcttgatcgtctgggcctgtgtttcagctgggatagggaaataactacgtgtttgccagattactacaagtggactcagtat

SEQ ID NO: 148466 - DNA, 4744 bp, Homo sapiens
  Payload ID: 9404
  Gene Symbol: LARS2
  Gene Name: leucyl-tRNA synthetase 2, mitochondrial
  Uniprot ID: Q15031
  ENST ID: ENST00000415258
  CDS Start-End: 142-2853
gctatcgataaagttgctgttttgacaacatggcggcgcccatggtccgtggcccggcagtgctcgcctaaaggtggagaacgaggagtagaggagccgcaggccagagcctgtgagcagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgataaatcgaagccaaaattttacgtgctttccatgttcccttatccttctggtaagctgcacatgggccatgtgcgtgtctacaccatcagcgacaccatagcacggttccagaagatgagagggatgcaggtcatcaaccccatgggatgggatgcttttggattgcctgctgaaaatgccgcagtcgagaggaatctacatccacaaagttggacacaaagtaatattaaacacatgaggaaacagcttgatcgtctgggcctgtgtttcagctgggatagggaaataactacgtgtttgccagattactacaagtggactcagtatctctttattaaactgtatgaggctgggctggcctatcaaaaggaggccctggttaactgggacccagtggatcaaacagtgcttgccaatgagcaggtggatgaacatggctgttcatggcgttctggagcaaaggtggaacagaagtacctcagacaatggtttattaagacaaccgcttatgcaaaggccatgcaggacgcgttggcagaccttccagaatggtatggaataaaaggcatgcaagcccactggattggggactgtgtgggctgccacctggacttcacattaaaggttcatgggcaagccacgggcgaaaagctgactgcctatacggccacccctgaagccatttatggcacctcccacgtggccatctcgcccagccacagactcctacatgggcacagctctctgaaggaagccttgaggatggcccttgtccctggcaaagattgcctcacgcctgtaatggctgtgaacatgcttacccagcaggaggtccctgtcgttattttggccaaagctgacttggaaggctctctggattcaaaaataggaattcccagtactagctcagaggacaccatcttagcccaaaccctgggcctggcctactctgaagtcattgaaactttgccagatggcacagagagactgagcagctctgctgagttcacaggtatgacccggcaggatgcttttctagccctgactcagaaagcccgggggaagagagtgggtggagacgtgacaagtgataaactgaaagactggctgatttcacggcagcggtactggggcacaccaatccccattgtccactgcccagtctgtggccccacacctgtgcccctggaggacttgcctgtgaccctgcccaacatcgcgtctttcactggcaagggaggccccccactggccatggcttcagagtgggtgaactgctcctgcccaaggtgcaagggagcagccaagagagagacagacacgatggatacctttgttgattctgcttggtactacttcagatacactgaccctcataatccacacagcccttttaacacagcagtggccgattactggatgcctgtggatttgtacattggagggaaagaacatgccgtcatgcacttgttctatgcaagattctttagtcatttttgccatgatcaaaaaatggttaaacatagggagccttttcataagctgctggcccaaggccttatcaaggggcagacattccgcctaccatctggacagtatctacagagagaggaagtggatctcacaggttccgttcctgttcatgcaaaaacgaaagagaagttagaggtgacgtgggagaagatgagtaagtccaaacacaacggggtggacccagaggaagttgtggagcagtatgggatcgacacgattcggctctacatcctttttgctgcccctcctgagaaggatatcttgtgggatgtgaaaactgatgctctccctggggtgctgagatggcaacaacgactgtggaccttgacaactcggtttattgaggccagggcttctgggaagtctccccagcctcagctgctgagtaacaaggagaaagctgaggccaggaagctctgggagtacaagaactccgtcatctctcaggtgaccacccatttcacagaggacttctcactgaattctgcaatttctcagctgatgggactcagcaatgccctctcgcaagcctctcagagcgtcattctccacagccccgagtttgaggatgctttgtgtgccctgatggtaatggctgctccactggcccctcatgtaacctcagagatctgggcaggcctggcgctggtgccgaggaagctctgtgcccactacacttgggatgccagtgtgctgctccaggcatggcctgctgtggacccggagttcctgcagcagcctgaggttgtccagatggcagttctgatcaacaataaagcttgtggcaaaattcctgtgccccaacaagttgcccgggaccaggacaaagtccacgaatttgttcttcaaagcgagctgggtgtcaggcttttgcaaggacgaagcatcaagaagtccttcctttccccgagaactgccctcatcaacttcctggtgcaagattgacagccaggaggctgcagctaccacgagggcctctgaggaacctccttccaggcctgggatgagggggcgatgtctgctggcccaggggaagggaaaagacaaatgtcttgactgttgacctcggtcctgtggcagactgcagtcaacagtgtgcctctgtagtgtggcctggtgctggggtgaaggtgagctgggcaaaggagaaatatgagctactgaggagggggttggacatcctgcccctcaccccccacccacactgcaggtagaggaggccatctgatcccatgggaagccatcagagacactgctggtgggagcaggaaggagcagtgcccctcgagcagccaggaagcctgcggatctgggaaatggctctgccttaggcacttctcgggaatttgaggccagcctgaggaactgcaggactcaggtgcaatgtgccagccacttggaactgctaactgagcctccagatggtagtgaatggtctctttgccttcaggctggatgaggaagtcatttaggaaatgttcaaataaccaatatgtggaaatggacacagggatcttctgaagttgctttgaatcaaaaggcaggcagtgctggttcctctgcctgtgtccccaccactccccagctctgtcatgcaggcctgtcctccccaaccccagctggatgtgcctcccaggcctgctgtggttctgacacacaggatcccaggcaaggcaccacttcctcacatgaatgaggagcagcaagtcataaccactcccttgggtatacaatttgctgtgtagtgaagtggaaccaggctcaggctgctggtcccaacctcagagccccaccgcagcccagtagggatgcagcacgccccagagggctcatgtgggccccagatggcaatgccaccattgttgatgtgactccagagccagttattaggaagagcaagctcaccacagaggagtggaactgaggccccccagatgttgcctccggtgtccaagccacagcggtctggctgttgggaagatggccaggaatggactcataccattggcacattaggctaatcctggttttatgtgaagtcagcaattaagtgttcccactagaactgacctaagccactgattaatatttaatgagggaaggtaggggagaatctagccattttataatgccagaaatctatatatgttatctgatgccatttttctgaagtagcctcacatgtggtccccctgcagttcagcagttaacagatgacttttttagtgtaataaaatgtttatcatctatgacttcaggacatatgtgtgatcctggaatacaccatattccaatttcagagttaattacaaacagattgaggtattccatcatcatcggaagcattggctgtgtgtctgactccacatggaatgctataaagtgggatacatgtggttcttcttgttccagaacttacagtccatggtagacaacactgatacaggcaaactagcaacagcaattaagtcactggttctcagacttaatactctgcctggtcctcatgcccagatattccaatttaattggtccatggtgtggcttgaacaccaggaatctttaaaactccacaagtgattctaatgggcagcaaagtttgagaatcactggacacattgatgcacttgagccatcatttctatctagttcttcctcttcctaatcttcaggttagcggggataagtttggtccaggaccaagagttggaccaaaagggaagacaggggccagaagtctagagtgctagagccgacttgaatgtactcagtctcattgcacatggcagtgaatatggattaaatataagcccatgaaaatatttggtacaaggaa

SEQ ID NO: 148467 - DNA, 2800 bp, Homo sapiens
  Payload ID: 9404
  Gene Symbol: LARS2
  Gene Name: leucyl-tRNA synthetase 2, mitochondrial
  ENST ID: ENST00000414984
  CDS Start-End: 139-2721
atcgataaagttgctgttttgacaacatggcggcgcccatggtccgtggcccggcagtgctcgcctaaaggtggagaacgaggagtagaggagccgcaggccagagcctgtgagcagggccttctcaccttctgaagaatggcttctgtttggcagagattgggtttttatgcctctcttctgaaaagacagctaaatggtgggccagatgtcatcaagtgggaaaggagagtaattcccggatgtaccagaagcatctacagtgccacgggaaagtggacaaaagagtatacattgcagacaagaaaggatgttgagaaatggtggcatcaacgaataaaagaacaggcctccaaaatttcagaagctgatgtcatcaaccccatgggatgggatgcttttggattgcctgctgaaaatgccgcagtcgagaggaatctacatccacaaagttggacacaaagtaatattaaacacatgaggaaacagcttgatcgtctgggcctgtgtttcagctgggatagggaaataactacgtgtttgccagattactacaagtggactcagtatctctttattaaactgtatgaggctgggctggcctatcaaaaggaggccctggttaactgggacccagtggatcaaacagtgcttgccaatgagcaggtggatgaacatggctgttcatggcgttctggagcaaaggtggaacagaagtacctcagacaatggtttattaagacaaccgcttatgcaaaggccatgcaggacgcgttggcagaccttccagaatggtatggaataaaaggcatgcaagcccactggattggggactgtgtgggctgccacctggacttcacattaaaggttcatgggcaagccacgggcgaaaagctgactgcctatacggccacccctgaagccatttatggcacctcccacgtggccatctcgcccagccacagactcctacatgggcacagctctctgaaggaagccttgaggatggcccttgtccctggcaaagattgcctcacgcctgtaatggctgtgaacatgcttacccagcaggaggtccctgtcgttattttggccaaagctgacttggaaggctctctggattcaaaaataggaattcccagtactagctcagaggacaccatcttagcccaaaccctgggcctggcctactctgaagtcattgaaactttgccagatggcacagagagactgagcagctctgctgagttcacaggtatgacccggcaggatgcttttctagccctgactcagaaagcccgggggaagagagtgggtggagacgtgacaagtgataaactgaaagactggctgatttcacggcagcggtactggggcacaccaatccccattgtccactgcccagtctgtggccccacacctgtgcccctggaggacttgcctgtgaccctgcccaacatcgcgtctttcactggcaagggaggccccccactggccatggcttcagagtgggtgaactgctcctgcccaaggtgcaagggagcagccaagagagagacagacacgatggatacctttgttgattctgcttggtactacttcagatacactgaccctcataatccacacagcccttttaacacagcagtggccgattactggatgcctgtggatttgtacattggagggaaagaacatgccgtcatgcacttgttctatgcaagattctttagtcatttttgccatgatcaaaaaatggttaaacatagggagccttttcataagctgctggcccaaggccttatcaaggggcagacattccgcctaccatctggacagtatctacagagagaggaagtggatctcacaggttccgttcctgttcatgcaaaaacgaaagagaagttagaggtgacgtgggagaagatgagtaagtccaaacacaacggggtggacccagaggaagttgtggagcagtatgggatcgacacgattcggctctacatcctttttgctgcccctcctgagaaggatatcttgtgggatgtgaaaactgatgctctccctggggtgctgagatggcaacaacgactgtggaccttgacaactcggtttattgaggccagggcttctgggaagtctccccagcctcagctgctgagtaacaaggagaaagctgaggccaggaagctctgggagtacaagaactccgtcatctctcaggtgaccacccatttcacagaggacttctcactgaattctgcaatttctcagctgatgggactcagcaatgccctctcgcaagcctctcagagcgtcattctccacagccccgagtttgaggatgctttgtgtgccctgatggtaatggctgctccactggcccctcatgtaacctcagagatctgggcaggcctggcgctggtgccgaggaagctctgtgcccactacacttgggatgccagtgtgctgctccaggcatggcctgctgtggacccggagttcctgcagcagcctgaggttgtccagatggcagttctgatcaacaataaagcttgtggcaaaattcctgtgccccaacaagttgcccgggaccaggacaaagtccacgaatttgttcttcaaagcgagctgggtgtcaggcttttgcaaggacgaagcatcaagaagtccttcctttccccgagaactgccctcatcaacttcctggtgcaagattgacagccaggaggctgcagctaccacgagggcctctgaggaacctccttccaggcctgggatgagggggcgatgtctgctg

SEQ ID NO: 148468 - DNA, 3969 bp, Homo sapiens
  Payload ID: 9405
  Gene Symbol: LIF
  Gene Name: leukemia inhibitory factor
  Uniprot ID: P15018
  ENST ID: ENST00000249075
  CDS Start-End: 157-765
cttcctggactggggatcccggctaaatatagctgtttctgtcttacaacacaggctccagtatataaatcaggcaaattccccatttgagcatgaacctctgaaaactgccggcatctgaggtttcctccaaggccctctgaagtgcagcccataatgaaggtcttggcggcaggagttgtgcccctgctgttggttctgcactggaaacatggggcggggagccccctccccatcacccctgtcaacgccacctgtgccatacgccacccatgtcacaacaacctcatgaaccagatcaggagccaactggcacagctcaatggcagtgccaatgccctctttattctctattacacagcccagggggagccgttccccaacaacctggacaagctatgtggccccaacgtgacggacttcccgcccttccacgccaacggcacggagaaggccaagctggtggagctgtaccgcatagtcgtgtaccttggcacctccctgggcaacatcacccgggaccagaagatcctcaaccccagtgccctcagcctccacagcaagctcaacgccaccgccgacatcctgcgaggcctccttagcaacgtgctgtgccgcctgtgcagcaagtaccacgtgggccatgtggacgtgacctacggccctgacacctcgggtaaggatgtcttccagaagaagaagctgggctgtcaactcctggggaagtataagcagatcatcgccgtgttggcccaggccttctagcaggaggtcttgaagtgtgctgtgaaccgagggatctcaggagttgggtccagatgtgggggcctgtccaagggtggctggggcccagggcatcgctaaacccaaatgggggctgctggcagaccccgagggtgcctggccagtccactccactctgggctgggctgtgatgaagctgagcagagtggaaacttccatagggagggagctagaagaaggtgccccttcctctgggagattgtggactggggagcgtgggctggacttctgcctctacttgtccctttggccccttgctcactttgtgcagtgaacaaactacacaagtcatctacaagagccctgaccacagggtgagacagcagggcccaggggagtggaccagcccccagcaaattatcaccatctgtgcctttgctgccccttaggttgggacttaggtgggccagaggggctaggatcccaaaggactccttgtcccctagaagtttgatgagtggaagatagagaggggcctctgggatggaaggctgtcttcttttgaggatgatcagagaacttgggcataggaacaatctggcagaagtttccagaaggaggtcacttggcattcaggctcttggggaggcagagaagccaccttcaggcctgggaaggaagacactgggaggaggagaggcctggaaagctttggtaggttcttcgttctcttccccgtgatcttccctgcagcctgggatggccagggtctgatggctggacctgcagcaggggtttgtggaggtgggtagggcaggggcaggttgctaagtcaggtgcagaggttctgagggacccaggctcttcctctgggtaaaggtctgtaagaaggggctggggtagctcagagtagcagctcacatctgaggccctgggaggccttgtgaggtcacacagaggtacttgagggggactggaggccgtctctggtccccagggcaagggaacagcagaacttagggtcagggtctcagggaaccctgagctccaagcgtgctgtgcgtctgacctggcatgatttctatttattatgatatcctatttatattaacttattggtgctttcagtggccaagttaattcccctttccctggtccctactcaacaaaatatgatgatggctcccgacacaagcgccagggccagggcttagcagggcctggtctggaagtcgacaatgttacaagtggaataagccttacgggtgaagctcagagaagggtcggatctgagagaatggggaggcctgagtgggagtggggggccttgctccacccccccccatcccctactgtgacttgctttagggtgtcagggtccaggctgcaggggctgggccaatttgtggagaggccgggtgcctttctgtcttgattccagggggctggttcacactgttcttgggcgccccagcattgtgttgtgaggcgcactgttcctggcagatattgtgccccctggagcagtgggcaagacagtccttgtggcccaccctgtccttgtttctgtgtccccatgctgcctctgaaatagcgccctggaacaaccctgcccctgcacccagcatgctccgacacagcagggaagctcctcctgtggcccggacacccatagacggtgcggggggcctggctgggccagaccccaggaaggtggggtagactggggggatcagctgcccattgctcccaagaggaggagagggaggctgcagatgcctgggactcagaccaggaagctgtgggccctcctgctccacccccatcccactcccacccatgtctgggctcccaggcagggaacccgatctcttcctttgtgctggggccaggcgagtggagaaacgccctccagtctgagagcaggggagggaaggaggcagcagagttggggcagctgctcagagcagtgttctggcttcttctcaaaccctgagcgggctgccggcctccaagttcctccgacaagatgatggtactaattatggtacttttcactcactttgcacctttccctgtcgctctctaagcactttacctggatggcgcgtgggcagtgtgcaggcaggtcctgaggcctggggttggggtggagggtgcggcccggagttgtccatctgtccatcccaacagcaagacgaggatgtggctgttgagatgtgggccacactcacccttgtccaggatgcagggactgccttctccttcctgcttcatccggcttagcttggggctggctgcattcccccaggatgggcttcgagaaagacaaacttgtctggaaaccagagttgctgattccacccggggggcccggctgactcgcccatcacctcatctccctgtggacttgggagctctgtgccaggcccaccttgcggccctggctctgagtcgctctcccacccagcctggacttggccccatgggacccatcctcagtgctccctccagatcccgtccggcagcttggcgtccaccctgcacagcatcactgaatcacagagcctttgcgtgaaacagctctgccaggccgggagctgggtttctcttccctttttatctgctggtgtggaccacacctgggcctggccggaggaagagagagtttaccaagagagatgtctccgggcccttatttattatttaaacatttttttaaaaagcactgctagtttacttgtctctcctccccatcgtccccatcgtcctccttgtccctgacttggggcacttccaccctgacccagccagtccagctctgccttgccggctctccagagtagacatagtgtgtggggttggagctctggcacccggggaggtagcatttccctgcagatggtacagatgttcctgccttagagtcatctctagttccccacctcaatcccggcatccagccttcagtcccgcccacgtgctagctccgtgggcccaccgtgcggccttagaggtttccctccttcctttccactgaaaagcacatggccttgggtgacaaattcctctttgatgaatgtaccctgtggggatgtttcatactgacagattatttttatttattcaatgtcatatttaaaatatttattttttataccaaatgaatacttttttttttaagaaaaaaaagagaaatgaataaagaatctactcttggctggc

SEQ ID NO: 148469 - DNA, 592 bp, Homo sapiens
  Payload ID: 9405
  Gene Symbol: LIF
  Gene Name: leukemia inhibitory factor
  Uniprot ID: P15018
  ENST ID: ENST00000403987
  CDS Start-End: 45-311
ggcatctgaggtttcctccaaggccctctgaagtgcagcccataatgaaggtcttggcggcagtacacagcccagggggagccgttccccaacaacctggacaagctatgtggccccaacgtgacggacttcccgcccttccacgccaacggcacggagaaggccaagctggtggagctgtaccgcatagtcgtgtaccttggcacctccctgggcaacatcacccgggaccagaagatcctcaaccccagtgccctcagcctccacagcaagctcaacgccaccgccgacatcctgcgaggcctccttagcaacgtgctgtgccgcctgtgcagcaagtaccacgtgggccatgtggacgtgacctacggccctgacacctcgggtaaggatgtcttccagaagaagaagctgggctgtcaactcctggggaagtataagcagatcatcgccgtgttggcccaggccttctagcaggaggtcttgaagtgtgctgtgaaccgagggatctcaggagttgggtccagatgtgggggcctgtccaagggtggctggggcccagggcatcgctaaacccaaatgggggctgctg

SEQ ID NO: 148470 - DNA, 10089 bp, Homo sapiens
  Payload ID: 9406
  Gene Symbol: LIFR
  Gene Name: leukemia inhibitory factor receptor alpha
  Uniprot ID: P42702
  ENST ID: ENST00000263409
  CDS Start-End: 164-3457
aatcctaaccctctctcccagaacgtgtctctgctgcaaggcaccgggccctttcgctctgcagaactgcacttgcaagaccattatcaactcctaatcccagctcagaaagggagcctctgcgactcattcatcgccctccaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattctgtgggattaattattgccattctcatcccagtggcagtggctgtcattgttggagtggtgacaagtatcctttgctatcggaaacgagaatggattaaagaaaccttctaccctgatattccaaatccagaaaactgtaaagcattacagtttcaaaagagtgtctgtgagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagtgttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatgtgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacaaaaattaatataatttttaatgtagtgacagcgatttagtgttttgtttgataaagtatgcttatttctgtgcctactgtataatggttatcaaacagttgtctcaggggtacaaactttgaaaacaagtgtgacactgaccagcccaaatcataatcatgttttcttgctgtgataggttttgcaagccttttcattattttttagcttttatgcttgcttccattatttcagttggttgccctaatatttaaaatttacacttctaagactagagacccacattttttaaaaatcattttattttgtgatacagtgacagctttatatgagcaaattcaatattattcataagcatgtaattccagtgacttactatgtgagatgactactaagcaatatctagcagcgttagctgtccatatagttctgattggatttcgttcctcctgaggagaccatgccgttgagcttggctacccaggcagtggtgatctttgacaccttctggtggatgttcctcccactcatgagtcttttcatcatgccacattatctgatccagtcctcacatttttaaatataaaactaaagagagaatgcttcttacaggaacagttacccaagggctgtttcttagtaactgtcataaactgatctgaatccatgggcatacctgtgttgcaggtgcagcaattgcttggtgagctgtgcagaattgattgccttcagcacagcatcctctgcccacccttgtttctcataagcgatgtctggagtgattgtggttcttggaaaagcagaaggaaaaactaaaaagtgtatcttgtattttccctgccctcaggttgcctatgtattttaccttttcatatttaaggcaaaagtacttgaaaattttaagtgtccgaataagatatgtcttttttgtttgttttttttggttgtttgtttgttttttatcatctgagattctgtaatgtatttgcaaataatggatcaattaattttttttgaagctcatattgtatctttttaaaaaccatgttgtggaaaaaagccagagtgacaagtgacaaaatctatttaggttctctgtgtatgaatcctgattttaactgctaggattcagctaaatttctgagctttatgatctgtggaaatttggaatgaaatgcaattcattttgtacatacatagtatattaaaactatataatagttcatagaaatgttcagtaatgaaaaatatatccaatcagagccatccctaaagagtgttctcttgtcttcctttgtatcctctttggctccttcccttagcttccaccccagacatcagacctggggctgccttctctccctgccaaagcttgctgttagcattgtctgcttgccctcaactcctgccttgttccctgttgaaatgtatcaatcccgtactttatctctccaggacaaggataagtgtggctacagtaaaagtttattgctctaaacggcgctaacctgagataatgagaaaaggccagaagagattgtttgatctctgtctgtcaatatatatgcatttcaactgtgaccatctggatccagggccctttctaacctatataacgactcatttgtttggttaatgatgaatatcactggggctcttaagtcctttcgttctatccaagacttcattgtttttttctgtatgaaaaaagtgcagaatatcactcacctttcccctacttttggatcccctacacgaggatcactagcttaatgagaagcagagtaacgctattaagtctgggcaagctccttataagttgctgtgtgcttaaaagaatgtgatttatgtctggggccaaagcagttttccttcttttccctcattgaattcaagacagctagacccttgtgtagatcccaggatattacctctactccccccaacctgtgtgtgtagggagagtaacaacacgggaagaggggagggaagttggaaggagattggtcacatgttcagttgtctgagatactggtaaatgtgcgctgtttgtcaatgaaggttgcatgcctgcatttacaaggtggtctcatactgattgtgctctgtccagttagattcgtggcttctcccttggaagctacaattaaggactagttagaagcagaggctagatgtgttctctccagcccttactaactgggaaaataattgagaaatccctcttttcctcagtgaaagcccagtcattggttagaaaaatctaattgtcaaactagcattatgttccatcatatctgtgggatagtaattcatgtaagacacatttttacctctcttacaagtcaattcacttacaagccagtttcaaatcaagcttcccttgcgaggaatggagatcattatggggcttattatgactacatttcttttatgagtgaccattttaaataattaatattttatttaatattaaattattaaagacttagctagacttttaacattagatgaaccttgtgaatcatatattgcatagattagcacatgtatgcaatctaggtcatcaatttgttgaatttatacagccctagatttgagattgtggccctgagtatctggatagttgagttgtgtgtttatgtgcttatatgatagaggtgctttgttcctgcagcttagaaacagaagcagccattcactgagaagcttaagagaggaagtatcaacctcattttccaaaccagcattactttcaccgctcgtggatctgaaagattacatttagaacatttagtactattacactctcagaaactgtggtaaaaagtcacattttcaaaacttcatgcatattgtattcttgttggaaataagtcctatagtttcttaattgtcttcatgccgtccatatttaacaaacattgcaagtcctttttatatttgggtaattatttgtaatttagtgaaggagactaggggatgttttcttccaaagggaatttaaaatcaattttatggtattttgaaagtaaaatactccttaacgtgtcaatatttttaaaatgttatctcgaagttttctattgctcaggtatataatctaataaaattttttgtttgctctaaggttatttttgctattctctattttgaattatgttaaaatttgtgtgcattttatgaaatgccttttttcttattttgaaagtgtaaaattgggcatctcagagtaaaatgtgggattattagctacaaagactaggcacatcgtgaaagctcagtaactaattttcttgactgagtcctatcccagagtgtcacagattcaacagaattttcctgaagggtgatacacaccaaaatctagcttgtgtggatctgagactattgactcaaagattcaaatctacttcggaagtgactccacggtttgagtgaaaactgaggaaggactcatgcctgtatatcactagatatcttatttctccataattttaagtgttcataatttcttcttctttgatgggtgtgcaactggggcatgtttgtaccagccagcatgtgttctgcccaacagtgtgtccgtgtgtgaggttaactgattcagaactcattctcttgataaactatttcttgaaagcatttattttaagtctttatttcctgctgaaatgaagtttcatgctgtcatgcccatcttatttattctagaagaaaattttcatagaagaaaatgatttatggccaaagttacagaacattcatcttttagacttagccttagaatatcattggaaattacttggcttgaatttggttcgtttttatctttatggattatgtaccagggctattaataatacttaaaccccttattttgctatggtggttagatttttttattccttttcaattagtgctattaattattacatggtcgtattcatgcttattacagatgaactatttttagtgccagtgtaaaggattaagaataacattcaattagttggctatttcaggctttattgtacatggtaatgtttcagggagtgtgatttggtctagaatatatccagatccttgtaattatgatattgggttatgacaggattctattatttttagctatgaatggtgcttatttttccctatattaggaatgttaatatttggattatcagagtccatgttataaacagaatttacctatgcaagacaaattctaactgtgcaacattttcatgagaattaaaagttgtgtgttaaggggaaaaccctctgaatgtttttatgtgtaagtgcctaaagaaccgtagaaacagtacatcaaaagctcttataaaagaaaaactgattgaacattagccagaaacaaaatatgatttacatttttttttttggttgctgggactgaataccctaaaaactaagagatgtgagtggggaaaatgtctaattgataagaaagttgatttatattatatttacatgcatcttctaagattgcctttacagtagccaatcagaactttaaaaaaaaaaaagctaacaacatagatcctatgtgttgcccttaagactaaaatactttgcacacgtgattgaatggctcacttaagttgttgaatttccttatacatttaaagtgtacttccgttaagaattattccattttaaatgggtaactttcagcttccgaactattttcctaaacattccagttgtgtattataaaagatcaaaatatctctaggtggtagtacaattttcatttataacgtggaaaagttaactgttaggtttaacattagtattagtgtttttgcaattgctcatagaaaagaacactgaataatggttttcatacaatttttgtaaaacattcttctcccagtttgattccaaatgcttttccccaaattgtctaatatatcataagctagtgtttccttgtatttaatttttccttccaacacaatatttaggaaaaatatgaataacattgtgagtagcgggagacaacacgaaaaagaaacctttcattgttgtggaggggtaggtgttatgtgattgatgcccttcctggcgtttgttttatcctgttattttctcaaaaaagagcacggctttttcttaaatacatttaaattcagaattgcttgcaaaagattggcctggatagatagacatcctagatttaagatagtaccatcttaaaagtatgttgaaaggtaaaataaatcatttcaaaatacttaactttcctaataaggatgttaggttttcttctctttcattagctggccataagtcaaggtccttataacactaggaaattacctttttttactttcaaaattgcattatagtgaattactgtttacaaaatacacatactgtgaacagatataagtttctgtcttttataaggtttgtagaatgaatgtttttttaaagtgagtattatatgttaaatattttaagttttttataaatactagtaactgtttactaatttttgtttggtcaaatgcttgtaaatgtagctgaaagaagatagggagaaactgcggatcccaaactgttccctttttcatttcttgaaatgttaccactacagacatttttttaaggtgaataaacagttgtgatgtgctgtacctaaaatcatgtttaatcgtataaggaaacatttcaatacacttatacaggaagaaaactatagatgaagtacatgtgtgtgattcagtctgattcacagaattctgagagtaatatggaataaaacaactccacttagatgataactgaagcatttcctgccttgtgaaaatttggattttaaattgctgttagaatgggaaatttggacactttatatcattgtataatttcagaatttagtttctgtatcttttggaaaacatgattatagcaaaaacatagaaaataatctattactaaaacaccataaatgtaaaactagtatgcttggctgttaactctaaagatgttacttatgtctgtttttaaaacatgcatgtatttaacaattttatcatagtattgtcatggaaaaaataaatatattttcttacatctta

SEQ ID NO: 148471 - DNA, 4253 bp, Homo sapiens
  Payload ID: 9406
  Gene Symbol: LIFR
  Gene Name: leukemia inhibitory factor receptor alpha
  Uniprot ID: P42702
  ENST ID: ENST00000453190
  CDS Start-End: 333-3626
agtcccggctggagcgactcggccgtggcggtggccgttaccgttgcctctgggaggctctggcggcggcggcggcccgcggggttcgcggagcgcagcgggccgcccttcgcccgtggccgcctcaagcagcctcgcgccgacacaggggaggcgagacggcggctgcggaggcggcggcgcattgtgcccggccccctccttggcggctcctgcccccgggcggctgtgggatctgggcagccccggggcggcggccgaggctacagagccggcggcaggggatggcaagatagcggcgcgggagcgtaccgactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattctgtgggattaattattgccattctcatcccagtggcagtggctgtcattgttggagtggtgacaagtatcctttgctatcggaaacgagaatggattaaagaaaccttctaccctgatattccaaatccagaaaactgtaaagcattacagtttcaaaagagtgtctgtgagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagtgttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatgtgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacaaaaattaatataatttttaatgtagtgacagcgatttagtgttttgtttgataaagtatgcttatttctgtgcctactgtataatggttatcaaacagttgtctc

SEQ ID NO: 148472 - DNA, 760 bp, Homo sapiens
  Payload ID: 9406
  Gene Symbol: LIFR
  Gene Name: leukemia inhibitory factor receptor alpha
  ENST ID: ENST00000506990
  CDS Start-End: 384-760
ggagcgactcggccgtggcggtggccgttaccgttgcctctgggaggctctggcggcggcggcggcccgcggggttcgcggagcgcagcgggccgcccttcgcccgtggccgcctcaagcagcctcgcgccgacacaggggaggcgagacggcggctgcggaggcggcggcgcattgtgcccggccccctccttggcggctcctgcccccgggcggctgtgggatctgggcagccccggggcggcggccgaggctacagagccggcggcaggggatggcaagatagcggcgcgggagcgtaccgtgatcggagcagctatttcctcttcaagaattgaattgagacttctttgctttgtaataggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcac

SEQ ID NO: 148473 - DNA, 757 bp, Homo sapiens
  Payload ID: 9406
  Gene Symbol: LIFR
  Gene Name: leukemia inhibitory factor receptor alpha
  ENST ID: ENST00000506003
  CDS Start-End: 1-200
aatggagcaataaaaaacaacatttaacaacagaagccagtccttcaaaggggcctgatacttggagagagtggagttctgatggaaaaaatttaataatctattggaagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccag

SEQ ID NO: 148474 - DNA, 574 bp, Homo sapiens
  Payload ID: 9406
  Gene Symbol: LIFR
  Gene Name: leukemia inhibitory factor receptor alpha
  ENST ID: ENST00000511561
  CDS Start-End: 351-574
caaacgcgtccggcatacagcgtaaacatcttcagaccgtgattctgcgccatcaaacgctctccagctaatttcatttggtgattactctgctagaaaaccgaggccaagtgaaactgcggaaatgggaacaatgtacggaggaaaaatctcaccccattaagagatccgtttcttctccgcacaaataagcccaccccgcctccgaggcaagactagatggctccaggatactctcggcgcgcccgctggccatctcgggcaggggagccccacacccggcaggaggaccaggacgcgagcggcggcgcctcggccctgggctgtttaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccg

SEQ ID NO: 148475 - DNA, 2210 bp, Homo sapiens
  Payload ID: 9407
  Gene Symbol: LNP1
  Gene Name: leukemia NUP98 fusion partner 1
  Uniprot ID: A1A4G5
  ENST ID: ENST00000383693
  CDS Start-End: 1281-1817
ggttaagggaaagcgtgggtgtgagtaggagtcttcggaaaccctttttctttcttttcgccccgctgctgttcgggagatggacttctggagtccccgtcgtagctggtgttgtcccctctaccttcaggaaagaagggcagatggccctcttgcctactgaagccgaggaggggcgcgtatacagcgggctaagggcgctcaagagatccgagtggaagaaaaagcagcggcacagcactggaatgggcgggagtggcagaagagttgtgaaggctattggctagcaagggtggtgggcggggcgtagaccgagctacccagtttactggtcgatttcggatccagttttccagttatagccacgttggcacctcttgaacctctgtggccgttagcacggttttctgcccgcgtgcccgagaaaccaacggattagaaggacttttaaagatgtgtgaggaaagagctcaccgctgaagaaggctgctgcatcactgaacttcttatcactaacatagcgagattttagtttggacgaatttgaggttataggggagatagcgatggcagaagactaggtggaaatggcacatctaggttggctgcagtcgaaacggtttgagcgtggtcgctgtggctcatcgtcggcaccaattaacgaagcgatgacatctgcgttgttaggggtttcttaaactgagttggtagaaatgcgaagcgtcagggttcccgccggcttcgagcctttcttggcgtatttgtatcttgagctgatttctgcgtcagcccacatctcgctctgatccgcacgccccccgggttgttttgcagtagcagtctcagccctcttctcgtctcattcccaaatcgtaatttcagttcacagctttttatctataatagctttatcaactctttttccgatgctctgcaccagatctcttaaaatataaaattaccttgcaaggtattgtttggaatacacggtattttcatgaagacaactattaatagaaaaatcagagtccagaactatggttctccatttctggtatactggtttgcagaagccttacattaagatttcataaatgattgttttgctgttaagtgcaacaacatcacagtagagctacataaagattgaaaggagatattttatcaagtggcaccagaatggactgattaaaatagaatggcctaattggaaagaatttcaggatcaccggtttctcctgcttcatggacaggccttcagtatttggcatcacctttacatggagcacaaagatgatgatgatgatgatgtgtcttttgccaaatggatgagcagcttctggggccacagctggagagaggaggatcagagaggactccgggaacgccaccgactgcaagccaccagtcacaggaaaacctccctgccctgcccacttcctgtgcttcccagaattccatcatctgactgccatcctagaaggcattctcatgaggaccaagaatttcgatgccgtagccacgtacgggattacagaaaatactcagaggatgggtcattcaaggagccactggaatcaaaaggaagatcccattccaaaattgagaaattttcagagtcctttgaacggcaactgtgctttagaaccaagcgttctgcctctttgggacctgaaagcagaaaggagagaaatgaaagagaatgcctgaggatggagataaaatcccgaaagaaagtagaggaagaaaggagctctaggaaagaagagcatggagaagcacacatggctcccctgtttgaaaaagggcctgaataatactctgcttctgcctcatgacatcagatgctactgttttggtttttttctttgagccccaattcaccatttcaggatgtggatgggggcggggttgggggtaaaaacagctataaaaagcaactgcagatgctgactgactgcagtgggcagggtatgtagctgctccaagatgacttgcatcataccccaattactgctggcatcttagttgagagtataatctgcttggttgcctttttatgggaataaagagaataaaaggtattttaatagaataaagaaaaatttgaaaatataatggaaggtatttaaagagccacccacatagcttcaccaacccttctcacacatcaactcataaatcatcttaaataaaagtcattggtatga

SEQ ID NO: 148476 - DNA, 1813 bp, Homo sapiens
  Payload ID: 9407
  Gene Symbol: LNP1
  Gene Name: leukemia NUP98 fusion partner 1
  ENST ID: ENST00000489752
  CDS Start-End: 863-1438
cccgagaaaccaacggattagaaggacttttaaagatgtgtgaggaaagagctcaccgctgaagaaggctgctgcatcactgaacttcttatcactaacatagcgagattttagtttggacgaatttgaggttataggggagatagcgatggcagaagactaggtggaaatggcacatctaggttggctgcagtcgaaacggtttgagcgtggtcgctgtggctcatcgtcggcaccaattaacgaagcgatgacatctgcgttgttaggggtttcttaaactgagttggtagaaatgcgaagcgtcagggttcccgccggcttcgagcctttcttggcgtatttgtatcttgagctgatttctgcgtcagcccacatctcgctctgatccgcacgccccccgggttgttttgcagtagcagtctcagccctcttctcgtctcattcccaaatcgtaatttcagttcacagctttttatctataatagctttatcaactctttttccgatgctctgcaccagatctcttaaaatataaaattaccttgcaaggtattgtttggaatacacggtattttcatgaagacaactattaatagaaaaatcagagtccagaactatggttctccatttctggtatactggtttgcagaagccttacattaagatttcataaatgattgttttgctgttaagtgcaacaacatcacagtagagctacataaagattgaaaggagatattttatcaagtggcaccagaatggactgattaaaatagaatggcctaattggaaagaatttcaggatcaccggtttctcctgcttcatggacaggccttcagtatttggcatcacctttacatggagcacaaagatgatgatgatgatgatgtgtcttttgccaaatggatgagcagcttctggggccacagctggagagaggaggatcagagaggactccgggaacgccaccgactgcaagccaccagtcacaggaaaacctccctgccctgcccatccttttatactgtaaattttttcattctgtattctcagcttcctgtgcttcccagaattccatcatctgactgccatcctagaaggcattctcatgaggaccaagaatttcgatgccgtagccacgtacgggattacagaaaatactcagaggatgggtcattcaaggagccactggaatcaaaaggaagatcccattccaaaattgagaaattttcagagtcctttgaacggcaactgtgctttagaaccaagcgttctgcctctttgggacctgaaagcagaaaggagagaaatgaaagagaatgcctgaggatggagataaaatcccgaaagaaagtagaggaagaaaggagctctaggaaagaagagcatggagaagcacacatggctcccctgtttgaaaaagggcctgaataatactctgcttctgcctcatgacatcagatgctactgttttggtttttttctttgagccccaattcaccatttcaggatgtggatgggggcggggttgggggtaaaaacagctataaaaagcaactgcagatgctgactgactgcagtgggcagggtatgtagctgctccaagatgacttgcatcataccccaattactgctggcatcttagttgagagtataatctgcttggttgcctttttatgggaataaagagaataaaaggtattttaatagaataaagaaaaatttgaaaatataatggaaggtatttaaagagccacccacatagcttcaccaacccttctcacacatcaactcataaatcatcttaaa

SEQ ID NO: 148477 - DNA, 1723 bp, Homo sapiens
  Payload ID: 9407
  Gene Symbol: LNP1
  Gene Name: leukemia NUP98 fusion partner 1
  ENST ID: ENST00000466996
  CDS Start-End: 942-1112
cggatccagttttccagttatagccacgttggcacctcttgaacctctgtggccgttagcacggttttctgcccgcgtgcccgagaaaccaacggattagaaggacttttaaagatgtgtgaggaaagagctcaccgctgaagaaggctgctgcatcactgaacttcttatcactaacatagcgagattttagtttggacgaatttgaggttataggggagatagcgatggcagaagactaggtggaaatggcacatctaggttggctgcagtcgaaacggtttgagcgtggtcgctgtggctcatcgtcggcaccaattaacgaagcgatgacatctgcgttgttaggggtttcttaaactgagttggtagaaatgcgaagcgtcagggttcccgccggcttcgagcctttcttggcgtatttgtatcttgagctgatttctgcgtcagcccacatctcgctctgatccgcacgccccccgggttgttttgcagtagcagtctcagccctcttctcgtctcattcccaaatcgtaatttcagttcacagctttttatctataatagctttatcaactctttttccgatgctctgcaccagatctcttaaaatataaaattaccttgcaaggtattgtttggaatacacggtattttcatgaagacaactattaatagaaaaatcagagtccagaactatggttctccatttctggtatactggtttgcagaagccttacattaagatttcataaatgattgttttgctgttaagtgcaacaacatcacagtagagctacataaagattgaaaggagatattttatcaagtggcaccagaatggactgattaaaatagaatggcctaattggaaagaatttcaggatcaccggtttctcctgcttcatggacaggccttcagtatttggcatcacctttacatggagcacaaagatgatgatgatgatgatgtgtcttttgccaaatggatgagcagcttctggggccacagctggagagaggaggatcagagaggactccgggaacgccaccgactgcaagccaccagtcacaggaaaacctccctgccctgcccaaattccatcatctgactgccatcctagaaggcattctcatgaggaccaagaatttcgatgccgtagccacgtacgggattacagaaaatactcagaggatgggtcattcaaggagccactggaatcaaaaggaagatcccattccaaaattgagaaattttcagagtcctttgaacggcaactgtgctttagaaccaagcgttctgcctctttgggacctgaaagcagaaaggagagaaatgaaagagaatgcctgaggatggagataaaatcccgaaagaaagtagaggaagaaaggagctctaggaaagaagagcatggagaagcacacatggctcccctgtttgaaaaagggcctgaataatactctgcttctgcctcatgacatcagatgctactgttttggtttttttctttgagccccaattcaccatttcaggatgtggatgggggcggggttgggggtaaaaacagctataaaaagcaactgcagatgctgactgactgcagtgggcagggtatgtagctgctccaagatgacttgcatcataccccaattactgctggcatcttagttgagagtataatctgcttggttgcctttttatgggaataaagagaataaa

SEQ ID NO: 148478 - DNA, 1410 bp, Homo sapiens
  Payload ID: 9408
  Gene Symbol: LECT1
  Gene Name: leukocyte cell derived chemotaxin 1
  Uniprot ID: O75829
  ENST ID: ENST00000377962
  CDS Start-End: 80-1084
gccctgcacgtcggggcagcgggacagatcccagggtgcccagggagtctccaagtgcctcactcctcccgccgcaaacatgacagagaactccgacaaagttcccattgccctggtgggacctgatgacgtggaattctgcagccccccggcgtacgctacgctgacggtgaagccctccagccccgcgcggctgctcaaggtgggagccgtggtcctcatttcgggagctgtgctgctgctctttggggccatcggggccttctacttctggaaggggagcgacagtcacatttacaatgtccattacaccatgagtatcaatgggaaattacaagatgggtcaatggaaatagacgctgggaacaacttggagacctttaaaatgggaagtggagctgaagaagcaattgcagttaatgatttccagaatggcatcacaggaattcgttttgctggaggagagaagtgctacattaaagcgcaagtgaaggctcgtattcctgaggtgggcgccgtgaccaaacagagcatctcctccaaactggaaggcaagatcatgccagtcaaatatgaagaaaattctcttatctgggtggctgtagatcagcctgtgaaggacaacagcttcttgagttctaaggtgttagaactctgcggtgaccttcctattttctggcttaaaccaacctatccaaaagaaatccagagggaaagaagagaagtggtaagaaaaattgttccaactaccacaaaaagaccacacagtggaccacggagcaacccaggcgctggaagactgaataatgaaaccagacccagtgttcaagaggactcacaagccttcaatcctgataatccttatcatcagcaggaaggggaaagcatgacattcgaccctagactggatcacgaaggaatctgttgtatagaatgtaggcggagctacacccactgccagaagatctgtgaacccctggggggctattacccatggccttataattatcaaggctgccgttcggcctgcagagtcatcatgccatgtagctggtgggtggcccgtatcttgggcatggtgtgaaatcacttcatatatcatgtgctgtaaaataagaactagctgaagagacaaccaaagaagcattaaggcaggttgatgctgataggaccacaaaatatttttacactcaacctgagcggttattcttgacactcttaacagaattttttcaattgttttccagaactttagtatatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtttgcc

SEQ ID NO: 148479 - DNA, 1444 bp, Homo sapiens
  Payload ID: 9408
  Gene Symbol: LECT1
  Gene Name: leukocyte cell derived chemotaxin 1
  Uniprot ID: O75829
  ENST ID: ENST00000448904
  CDS Start-End: 112-1113
ccgtgcaccgtgtgtgcgcgcggcgttgaaatgccctgcacgtcggggcagcgggacagatcccagggtgcccagggagtctccaagtgcctcactcctcccgccgcaaacatgacagagaactccgacaaagttcccattgccctggtgggacctgatgacgtggaattctgcagccccccggcgtacgctacgctgacggtgaagccctccagccccgcgcggctgctcaaggtgggagccgtggtcctcatttcgggagctgtgctgctgctctttggggccatcggggccttctacttctggaaggggagcgacagtcacatttacaatgtccattacaccatgagtatcaatgggaaattacaagatgggtcaatggaaatagacgctgggaacaacttggagacctttaaaatgggaagtggagctgaagaagcaattgcagttaatgatttccagaatggcatcacaggaattcgttttgctggaggagagaagtgctacattaaagcgcaagtgaaggctcgtattcctgaggtgggcgccgtgaccaaacagagcatctcctccaaactggaaggcaagatcatgccagtcaaatatgaagaaaattctcttatctgggtggctgtagatcagcctgtgaaggacaacagcttcttgagttctaaggtgttagaactctgcggtgaccttcctattttctggcttaaaccaacctatccaaaagaaatccagagggaaagaagagaagtggtaagaaaaattgttccaactaccacaaaaagaccacacagtggaccacggagcaacccaggcgctggaagactgaataatgaaaccagacccagtgttcaagaggactcacaagccttcaatcctgataatccttatcatcaggaaggggaaagcatgacattcgaccctagactggatcacgaaggaatctgttgtatagaatgtaggcggagctacacccactgccagaagatctgtgaacccctggggggctattacccatggccttataattatcaaggctgccgttcggcctgcagagtcatcatgccatgtagctggtgggtggcccgtatcttgggcatggtgtgaaatcacttcatatatcatgtgctgtaaaataagaactagctgaagagacaaccaaagaagcattaaggcaggttgatgctgataggaccacaaaatatttttacactcaacctgagcggttattcttgacactcttaacagaattttttcaattgttttccagaactttagtatatgcaaatgtactgaaagggtagttcaagtctaaaatgccataacccctttattatttgttattttttatttgcattgctttgccataagtcttcccttgcttgtatcttccaaagctattttgaaataaacatgaaaatttacagtttgccaaaaa

SEQ ID NO: 148480 - DNA, 731 bp, Homo sapiens
  Payload ID: 9408
  Gene Symbol: LECT1
  Gene Name: leukocyte cell derived chemotaxin 1
  ENST ID: ENST00000431550
  CDS Start-End: 344-731
ccgactgcaaaggaccctcgggagggagcgcggcgaaaggggcacccgtaggagcccgggcgagctgtttcccgcccgactccccactccctgggggctaccgcgtggggcccgggtgcgctgggggccgcaggtgctggcggcacaaacgcgacggtccctctcccgccccggcccgcaggcgtacgctacgctgacggtgaagccctccagccccgcgcggctgctcaaggtgggagccgtggtcctcatttcgggagctgtgctgctgctctttggggccatcggggccttctacttctggaaggggagcgacagtcacatttacaatgtccattacaccatgagtatcaatgggaaattacaagatgggtcaatggaaatagacgctgggaacaacttggagacctttaaaatgggaagtggagctgaagaagcaattgcagttaatgatttccagaatggcatcacaggaattcgttttgctggaggagagaagtgctacattaaagcgcaagtgaaggctcgtattcctgaggtgggcgccgtgaccaaacagagcatctcctccaaactggaaggcaagatcatgccagtcaaatatgaagaaaattctcttatctgggtggctgtagatcagcctgtgaaggacaacagcttcttgagttctaaggtgttagaactctgcggtgaccttcctattttctggcttaaaccaacctatccaaaag

SEQ ID NO: 148481 - DNA, 1077 bp, Homo sapiens
  Payload ID: 9409
  Gene Symbol: LECT2
  Gene Name: leukocyte cell-derived chemotaxin 2
  Uniprot ID: O14960
  ENST ID: ENST00000274507
  CDS Start-End: 202-657
aaatcaaatagctatccatggaatattagaacttgacttgctccatcctcttaaactttttgtgtctcacactaaagaaatgagagatgcagaattctaaggctaaatagctaggaagtattcattcaaacttgaatattcttcaaagagagtgtgggggcaactctaatcagaggaagaaactaaaggaagtaaaaccagatgttttccaccaaagccctccttttggctggtctgatttctaccgcactggcagggccatgggctaatatatgtgctggcaagtcttccaatgagatccggacgtgtgaccgccatggctgtggacagtactctgctcaaagaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagaggtttttgtgtcaaaatgttctacattaagccaattaagtataaaggtcctattaagaagggagaaaaacttggaactctattgcccttgcagaaagtttatcctggcatacaatcgcatgtgcacattgaaaactgtgactcgagtgaccctactgcatacctgtaaatcgaaggccaatggtcagatcttcaaaataaaaagtcatcttaaaaacctggatgcatacccttctcttcaagaaatttgtgttcacaaaggaaaaatgcatgaagggatggataccccattttccatgacatgattattacacattgcatgcctgtatcaaaacatctcacgtacctcataaacaaatacacctatgtacccacaaaaattttttaattaaaaaaaggaaatttgagtttaaatagaaacatgataaatgcaagaaagaaaacattttgattttaactcattgtcactctgatgttcatgtgaactggttgcttcgggctctttgatctgtcacctatggaatctgagtggttttattttttagatttctcagtcccgaagatctaagataaataaacaagagaactt

SEQ ID NO: 148482 - DNA, 789 bp, Homo sapiens
  Payload ID: 9409
  Gene Symbol: LECT2
  Gene Name: leukocyte cell-derived chemotaxin 2
  ENST ID: ENST00000514447
  CDS Start-End: 150-485
aaactttttgtgtctcacactaaagaaatgagagatgcagaattctaaggctaaatagctaggaagtattcattcaaacttgaatattcttcaaagagagtgtgggggcaactctaatcagaggaagaaactaaaggaagtaaaaccagatgttttccaccaaagccctccttttggctggtctgatttctaccgcactggcagggccatgggctaatatatgtgctggcaagtcttccaatgagatccggacgtgtgaccgccatggctgtggacagtactctgctcaaagaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagaggtaagagaggtggagtctacacctggggtgcctcctggagatgttgatgctcatttatttaatgcaggttccatacgtagagattttgtacttctttcaaaatgataaaacctggaacagaaagaatatagagtgtacccaaactagctgatgcattttttaaaaaacttttattttaggttcaggggtacatgtgcacatttgttatataggtaaaccacatgtcacagacatttggtgtacagattattttgtcacccaggtaataagcatagtacccgatagatatttttttctgatcctctcccagctgaggcactttcaaggacgtttcaccattttctctgaaaa

SEQ ID NO: 148483 - DNA, 762 bp, Homo sapiens
  Payload ID: 9409
  Gene Symbol: LECT2
  Gene Name: leukocyte cell-derived chemotaxin 2
  ENST ID: ENST00000512872
  CDS Start-End: 342-581
ctgaatcaggaaataaaattctggaaggacgatcttcccataaatacataaagtccagggaaaactacagtgaaaacagaattgtcaggatcaactgtgtgactgataaggcaaatggggataggaaatgtctgaggccaggagctctgctctcacttttctcctttttagcactggcagggccatgggctaatatatgtgctggcaagtcttccaatgagatccggacgtgtgaccgccatggctgtggacagtactctgctcaaagaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagaggtttttgtgtcaaaatgttctacattaagccaattaagtataaaggtcctattaagaagggagaaaaacttggaactctattgcccttgcagaaagtttatcctggcatacaatcgcatgtgcacattgaaaactgtgactcgagtgaccctactgcatacctgtaaatcgaaggccaatggtcagatcttcaaaataaaaagtcatcttaaaaacctggatgcatacccttctcttcaagaaatttgtgttcacaaaggaaaaatgcatgaagggatggataccccattttccatgacatgattattacacattgcatgcctgtatcaaaacatctcacgtacctca

SEQ ID NO: 148484 - DNA, 574 bp, Homo sapiens
  Payload ID: 9409
  Gene Symbol: LECT2
  Gene Name: leukocyte cell-derived chemotaxin 2
  ENST ID: ENST00000522943
  CDS Start-End: 130-525
taaagaaatgagagatgcagaattctaaggctaaatagctaggaagtattcattcaaacttgaatattcttcaaagagagtgtgggggcaactctaatcagaggaagaaactaaaggaagtaaaaccagatgttttccaccaaagccctccttttggctggtctgatttctaccgcactggcagggccatgggctaatatatgtgctggcaagtcttccaatgagatccggacgtgtgaccgccatggctgtggacagtactctgctcaaagaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagagaaattaccacagacaccccaatcttcaacaactactaccctgatcagtcagcggccgtcaacatcaagacgagatcctccaccagcaagaagatgatgactcactgaaggttcagatgatggttagcatttttttttcagtcaagcatttttaaat

SEQ ID NO: 148485 - DNA, 1910 bp, Homo sapiens
  Payload ID: 9410
  Gene Symbol: LILRA1
  Gene Name: leukocyte immunoglobulin-like receptor, subfamily A (with TM domain), member 1
  Uniprot ID: O75019
  ENST ID: ENST00000251372
  CDS Start-End: 183-1652
ctcactgccacacgcagctcaacctgagctacacagccagatgcgagatgcttctctgctgatctgagtctgcctgcagcatggaccttggtcttccctgaagcatctccagggctggagggacgactgccatgcaccgagggctcatccatccgcagagcagggcagtgggaggagacgctatgacccccatcgtcacagtcctgatctgtctcaggctgagtctgggcccccggacccacgtgcaggcagggaccctccccaagcccacactctgggctgagccaggctctgtgatcacccaggggagtcccgtgaccctctggtgtcaggggatcctggagacccaggagtaccgtctgtatagagaaaagaaaacagcaccctggattacacggatcccacaggagattgtgaagaagggccagttccccatcccatccatcacctgggaacacacagggcggtatcgctgtttctacggtagccacactgcaggctggtcagagcccagtgaccccctggagctggtggtgacaggagcctacatcaaacccaccctctcagctctacccagccctgtggtgacctcaggagggaacgtgaccctccattgtgtctcacaggtggcatttggcagcttcattctgtgtaaggaaggagaagatgaacacccacaatgcctgaactcacagccccgtacccatgggtggtcccgggccatcttctctgtgggccccgtgagcccgagtcgcaggtggtcgtacaggtgctatgcttatgactcgaactctccccatgtgtggtctctacccagtgatctcctggagctcctggtcctaggtgtttctaagaagccatcactctcagtgcagccaggtcctatagtggcccctggggagagcctgaccctccagtgtgtttctgatgtcagctacgacagatttgttctgtataaggagggagaacgtgacttcctccagctccctggcccacagccccaggctgggctctcccaggccaacttcaccctgggccctgtgagccgctcctacgggggccagtacagatgctccggtgcatacaacctctcctccgagtggtcggcccccagcgaccccctggacatcctgatcgcaggacagttccgtggcagacccttcatctcggtgcatccgggccccacggtggcctcaggagagaacgtgaccctgctgtgtcagtcatgggggccgttccacactttccttctgaccaaggcgggagcagctgatgcccccctccgtctcagatcaatacacgaatatcctaagtaccaggctgaattccctatgagtcctgtgacctcagcccactcggggacctacaggtgctacggctcactcagctccaacccctacctgctgtctcaccccagtgactccctggagctcatggtctcaggagcagctgagaccctcagcccaccacaaaacaagtccgattccaaggctggagcagctaacaccctcagcccatcacaaaacaagactgcctcacacccccaggattacacagtggagaatctcatccgcatgggcatagctggcttggtcctggtggtcctcgggattctgctatttgaggctcagcacagccagagaagcctctgagatgcagccgggaggtgaacagcagagagaagaatgtacccttcagagtggtggagccttgggaacagatctgatgatgccaggaggttccgggagacaatttagggctgatgctatctggactgtctgccaatcatttttagagggaggaatcagtgttggattgcagagacattttctggagtgatccatgaaggaccattaacctgtgatacctttcctctctattaatgttgacttcccttggttggatcctct

SEQ ID NO: 148486 - DNA, 2313 bp, Homo sapiens
  Payload ID: 9410
  Gene Symbol: LILRA1
  Gene Name: leukocyte immunoglobulin-like receptor, subfamily A (with TM domain), member 1
  Uniprot ID: O75019
  ENST ID: ENST00000453777
  CDS Start-End: 171-1040
cgcagctcaacctgagctacacagccagatgcgagatgcttctctgctgatctgagtctgcctgcagcatggaccttggtcttccctgaagcatctccagggctggagggacgactgccatgcaccgagggctcatccatccgcagagcagggcagtgggaggagacgctatgacccccatcgtcacagtcctgatctgtctcaggctgagtctgggcccccggacccacgtgcaggcagggaccctccccaagcccacactctgggctgagccaggctctgtgatcacccaggggagtcccgtgaccctctggtgtcaggggatcctggagacccaggagtaccgtctgtatagagaaaagaaaacagcaccctggattacacggatcccacaggagattgtgaagaagggccagttccccatcccatccatcacctgggaacacacagggcggtatcgctgtttctacggtagccacactgcaggctggtcagagcccagtgaccccctggagctggtggtgacaggagcctacatcaaacccaccctctcagctctacccagccctgtggtgacctcaggagggaacgtgaccctccattgtgtctcacaggtggcatttggcagcttcattctgtgtaaggaaggagaagatgaacacccacaatgcctgaactcacagccccgtacccatgggtggtcccgggccatcttctctgtgggccccgtgagcccgagtcgcaggtggtcgtacaggtgctatgcttatgactcgaactctccccatgtgtggtctctacccagtgatctcctggagctcctggtcctaggagcagctgagaccctcagcccaccacaaaacaagtccgattccaaggctggagcagctaacaccctcagcccatcacaaaacaagactgcctcacacccccaggattacacagtggagaatctcatccgcatgggcatagctggcttggtcctggtggtcctcgggattctgctatttgaggctcagcacagccagagaagcctctgagatgcagccgggaggtgaacagcagagagaagaatgtacccttcagagtggtggagccttgggaacagatctgatgatgccaggaggttccgggagacaatttagggctgatgctatctggactgtctgccaatcatttttagagggaggaatcagtgttggattgcagagacattttctggagtgatccatgaaggaccattaacctgtgatacctttcctctctattaatgttgacttcccttggttggatcctcttctttccccacccccagacagacatgaggctacatcccacatggcagcgttgggtccacacctctgcacatctgtgtgctctggtccatggtgtgtaacacagtcttctttattactcattgccatactccctggtgtgctttactgagcctccatctcttcaattcagagttccaaacgtgcttcagtaactaaatcaatgggagagtatcggatttcaaccaggaaaagataaatccaccctgatgccctgacaccctctctgaaccctacgagcccttccctccttctcacatgctacctgtgcagcttctccttagatcattgtgtaaccatcactgccatcctgttccacacatggtcatcaccctacacccattcagcagccactccccattccctcttccctccagcacctgctaaccacaaatgtgctttctgtctctacggatttgcctattctgtctgaaaacatttcaatctcctttgacctgtgagctcctcacttcgagacttcctgcctttccaggcagaaccaaagtacaccacgtcaaaagcaatgataggcatttgcagtgtgttggtgatccacgaaaggaaaatcacggaagcaggatagaaatccagctgcagacaagacctcaggtcgatgaatcttgacaagcagttgagctgtttttttctactcacctaggacagtcaggcagaagtatgcaaaatgactggggctgattcttttctgaattgtcgcaaacagcaagaggacttgagtcctagcattaaagagttcaacatgtctaggtccaagaccactgttgtgtttgaaggatgtaaaaccctgctgcataggatggaatatttggagggaggatcctgaaaaacatgagggatcaaatagtcctcaactttctaggacaaagggagcagctatttgccatctaccctccagaataaagaaatcttatcattcaccatctaccctctagaataaagaaatcttatcattcgccatcta

SEQ ID NO: 148487 - DNA, 1910 bp, Homo sapiens; identical to SEQ ID NO: 148485
  Payload ID: 9410
  Gene Symbol: LILRA1
  Gene Name: leukocyte immunoglobulin-like receptor, subfamily A (with TM domain), member 1
  Uniprot ID: O75019
  ENST ID: ENST00000617170
  CDS Start-End: 183-1652

SEQ ID NO: 148488 - DNA, 2313 bp, Homo sapiens; identical to SEQ ID NO: 148486
  Payload ID: 9410
  Gene Symbol: LILRA1
  Gene Name: leukocyte immunoglobulin-like receptor, subfamily A (with TM domain), member 1
  Uniprot ID: O75019
  ENST ID: ENST00000620606
  CDS Start-End: 171-1040

SEQ ID NO: 148489 - DNA, 1510 bp, Homo sapiens
  Payload ID: 9410
  Gene Symbol: LILRA1
  Gene Name: leukocyte immunoglobulin-like receptor, subfamily A (with TM domain), member 1
  ENST ID: ENST00000614904
  CDS Start-End: 1-1320
atgacccccatcctcacggtcctgatctgtctcgggctgagtctgggccccaggacccacgtgcaggcagggaccctccccaagcccacactctgggctgagccaggctctgtgatcacccaggggagtcccgtgaccctctggtgtcaggggatcctggagacccaggagtaccgtctgtatagagaaaagaaaacagcaccctggattacacggatcccacaggagattgtgaagaagggccagttccccatcccatccatcacctgggaacacacagggcggtatcgctgtttctacggtagccacactgcaggctggtcagagcccagtgaccccctggagctggtggtgacaggagcctacatcaaacccaccctctcagctctacccagccctgtggtgacctcaggagggaacgtgaccctccattgtgtctcacaggtggcatttggcagcttcattctgtgtaaggaaggagaagatgaacacccacaatgcctgaactcacagccccgtacccatgggtggtcccgggccatcttctctgtgggccccgtgagcccgagtcgcaggtggtcgtacaggtgctatgcttatgactcgaactctccccatgtgtggtctctacccagtgatctcctggagctcctggtcctaggtgtttctaagaagccatcactctcagtgcagccaggtcctatagtggcccctggggagagcctgaccctccagtgtgtttctgatgtcagctacgacagatttgttctgtataaggagggagaacgtgacttcctccagctccctggcccacagccccaggctgggctctcccaggccaacttcaccctgggccctgtgagccgctcctacgggggccagtacagatgctccggtgcatacaacctctcctccgagtggtcggcccccagcgaccccctggacatcctgatcgcaggacagttccgtggcagacccttcatctcggtgcatccgggccccacggtggcctcaggagagaacgtgaccctgctgtgtcagtcatgggggccgttccacactttccttctgaccaaggcgggagcagctgatgcccccctccgtctcagatcaatacacgaatatcctaagtaccaggctgaattccctatgagtcctgtgacctcagcccactcggggacctacaggtgctacggctcactcagctccaacccctacctgctgtctcaccccagtgactccctggagctcatggtctcaggagcagctgagaccctcagcccaccacaaaacaagtccgattccaaggctggtgagtgaggagatgcttgccgtgatgacgctgggcacagagggtcaggtcctgtcaaggggagctgggtgtcctgggtggacattttaaaaaattacattcattctaatttaaagaattcttcaacacctttaatgatttataagtgaagtatttcattcctttacatttttaaaataagagataactatccatgag

SEQ ID NO: 148490 - DNA, 1510 bp, Homo sapiens; identical to SEQ ID NO: 148489
  Payload ID: 9410
  Gene Symbol: LILRA1
  Gene Name: leukocyte immunoglobulin-like receptor, subfamily A (with TM domain), member 1
  ENST ID: ENST00000618665
  CDS Start-End: 1-1320

SEQ ID NO: 148491 - DNA, 2000 bp, Homo sapiens
  Payload ID: 9410
  Gene Symbol: LILRA1
  Gene Name: leukocyte immunoglobulin-like receptor, subfamily A (with TM domain), member 1
  ENST ID: ENST00000613536
  CDS Start-End: 222-1742
gggactatttggttgaaagaaaacccacaatccagtgtcaagaaagaagtcaacttttcttcccctatttccctgcatttctcctctgtgctcactgccacacgcagctcaacctgagctacacagccagatgcgagatgcttctctgctgatctgagtctgcctgcagcatggaccttggtcttccctgaagcatctccagggctggagggacgactgccatgcaccgagggctcatccatccgcagagcagggcagtgggaggagacgctatgacccccatcgtcacagtcctgatctgtctcaggctgagtctgggcccccggacccacgtgcaggcagggaccctccccaagcccacactctgggctgagccaggctctgtgatcacccaggggagtcccgtgaccctctggtgtcaggggatcctggagacccaggagtaccgtctgtatagagaaaagaaaacagcaccctggattacacggatcccacaggagattgtgaagaagggccagttccccatcccatccatcacctgggaacacacagggcggtatcgctgtttctacggtagccacactgcaggctggtcagagcccagtgaccccctggagctggtggtgacaggagcctacatcaaacccaccctctcagctctacccagccctgtggtgacctcaggagggaacgtgaccctccattgtgtctcacaggtggcatttggcagcttcattctgtgtaaggaaggagaagatgaacacccacaatgcctgaactcacagccccgtacccatgggtggtcccgggccatcttctctgtgggccccgtgagcccgagtcgcaggtggtcgtacaggtgctatgcttatgactcgaactctccccatgtgtggtctctacccagtgatctcctggagctcctggtcctaggtgtttctaagaagccatcactctcagtgcagccaggtcctatagtggcccctggggagagcctgaccctccagtgtgtttctgatgtcagctacgacagatttgttctgtataaggagggagaacgtgacttcctccagctccctggcccacagccccaggctgggctctcccaggccaacttcaccctgggccctgtgagccgctcctacgggggccagtacagatgctccggtgcatacaacctctcctccgagtggtcggcccccagcgaccccctggacatcctgatcgcaggacagttccgtggcagacccttcatctcggtgcatccgggccccacggtggcctcaggagagaacgtgaccctgctgtgtcagtcatgggggccgttccacactttccttctgaccaaggcgggagcagctgatgcccccctccgtctcagatcaatacacgaatatcctaagtaccaggctgaattccctatgagtcctgtgacctcagcccactcggggacctacaggtgctacggctcactcagctccaacccctacctgctgtctcaccccagtgactccctggagctcatggtctcaggagcagctgagaccctcagcccaccacaaaacaagtccgattccaaggctggagcagctaacaccctcagcccatcacaaaacaagactgcctcacacccccaggattacacagtggagaatctcatccgcatgggcatagctggcttggtcctggtggtcctcgggattctgctatttgaggctcagcacagccagagaagcctctgagatgcagccgggaggtgaacagcagagagaagaatgtacccttcagagtggtggagccttgggaacagatctgatgatgccaggaggttccgggagacaatttagggctgatgctatctggactgtctgccaatcatttttagagggaggaatcagtgttggattgcagagacattttctggagtgatccatgaaggaccattaacatgtgatacctttcctctctattaatgttgacttcccttggttggatcctct

SEQ ID NO: 148492 - DNA, 1510 bp, Homo sapiens; identical to SEQ ID NO: 148489
  Payload ID: 9410
  Gene Symbol: LILRA1
  Gene Name: leukocyte immunoglobulin-like receptor, subfamily A (with TM domain), member 1
  ENST ID: ENST00000613222
  CDS Start-End: 1-1320

SEQ ID NO: 148493 - DNA, 1910 bp, Homo sapiens; identical to SEQ ID NO: 148485
  Payload ID: 9410
  Gene Symbol: LILRA1
  Gene Name: leukocyte immunoglobulin-like receptor, subfamily A (with TM domain), member 1
  ENST ID: ENST00000616368
  CDS Start-End: 132-1652

SEQ ID NO: 148494 - DNA, 1510 bp, Homo sapiens; identical to SEQ ID NO: 148489
  Payload ID: 9410
  Gene Symbol: LILRA1
  Gene Name: leukocyte immunoglobulin-like receptor, subfamily A (with TM domain), member 1
  ENST ID: ENST00000618884
  CDS Start-End: 1-1320

SEQ ID NO: 148495 - DNA, 2688 bp, Homo sapiens
  Payload ID: 9410
  Gene Symbol: LILRA1
  Gene Name: leukocyte immunoglobulin-like receptor, subfamily A (with TM domain), member 1
  Uniprot ID: O75019
  ENST ID: ENST00000631007
  CDS Start-End: 255-1124
gaaaacccacaatccagtgtcaagaaagaagtcaacttttcttcccctatttccctgcatttctcctctgtgctcactgccacacgcagctcaacctgagctacacagccagatgcgagatgcttctctgctgatctgagtctgcctgcagcatggaccttggtcttccctgaagcatctccagggctggagggacgactgccatgcaccgagggctcatccatccgcagagcagggcagtgggaggagacgctatgacccccatcgtcacagtcctgatctgtctcaggctgagtctgggcccccggacccacgtgcaggcagggaccctccccaagcccacactctgggctgagccaggctctgtgatcacccaggggagtcccgtgaccctctggtgtcaggggatcctggagacccaggagtaccgtctgtatagagaaaagaaaacagcaccctggattacacggatcccacaggagattgtgaagaagggccagttccccatcccatccatcacctgggaacacacagggcggtatcgctgtttctacggtagccacactgcaggctggtcagagcccagtgaccccctggagctggtggtgacaggagcctacatcaaacccaccctctcagctctacccagccctgtggtgacctcaggagggaacgtgaccctccattgtgtctcacaggtggcatttggcagcttcattctgtgtaaggaaggagaagatgaacacccacaatgcctgaactcacagccccgtacccatgggtggtcccgggccatcttctctgtgggccccgtgagcccgagtcgcaggtggtcgtacaggtgctatgcttatgactcgaactctccccatgtgtggtctctacccagtgatctcctggagctcctggtcctaggagcagctgagaccctcagcccaccacaaaacaagtccgattccaaggctggagcagctaacaccctcagcccatcacaaaacaagactgcctcacacccccaggattacacagtggagaatctcatccgcatgggcatagctggcttggtcctggtggtcctcgggattctgctatttgaggctcagcacagccagagaagcctctgagatgcagccgggaggtgaacagcagagagaagaatgtacccttcagagtggtggagccttgggaacagatctgatgatgccaggaggttccgggagacaatttagggctgatgctatctggactgtctgccaatcatttttagagggaggaatcagtgttggattgcagagacattttctggagtgatccatgaaggaccattaacatgtgatacctttcctctctattaatgttgacttcccttggttggatcctcttctttccccacccccagacagacatgaggctacatcccacatggcagcgttgggtccacacctctgcacatctgtgtgctctggtccatggtgtgtaacacagtcttctttattactcattgccatactccctggtgtgctttactgagcctccatctcttcaattcagagttccaaacgtgcttcagtaactaaatcaatgggagagtatcggatttcaaccaggaaaagataaatccaccctgatgccctgacaccctctctgaaccctacgagcccttccctccttctcacatgctacctgtgcagcttctccttagatcattgtgtaaccatcactgccatcctgttccacacatggtcatcaccctacacccattcagcagccactccccattccctcttccctccagcacctgctaaccacaaatgtgctttctgtctctacggatttgcctattctgtctgaaaacatttcaatctcctttgacctgtgagctcctcacttcgagacttcctgcctttccaggcagaaccaaagtacaccacgtcaaaagcaatgataggcatttgcagtgtgttggtgatccacgaaaggaaaatcacggaagcaggatagaaatccagctgcagacaagacctcaggtcgatgaatcttgacaagcagttgagctgtttttttctactcacctaggacagtcaggcagaagtatgcaaaatgactggggctgattcttttctgaattgtcgcaaacagcaagaggacttgagtcctagcattaaagagttcaacatgtctaggtccaagaccactgttgtgtttgaaggatgtaaaaccctgctgcataggatggaatatttggagggaggatcctgaaaaacatgagggatcaaatagtcctcaactttctaggacaaagggagcagctatttgccatctaccctccagaataaagaaatcttatcattcaccatctaccctctagaataaagaaatcttatcattcgccatctaccctgtagaataaagaaatcttatcattcaccgtctaccctctagagtaaacaaatcttatcattcaccatctaccctctagaataaagaaatcttatcattcgccatctaccctctagaataaagaaatcttatcattcaccgtctaccctctagagtaaacaaatcttatcattcgccatctaccctctagaatagagaaatcttatcattcatcatctaccctccagaataaagaaatgttatcatttgccatctaccctctagaataaagaaatcttattaaggaca

SEQ ID NO: 148496 - DNA, 2688 bp, Homo sapiens
  Payload ID: 9410
  Gene Symbol: LILRA1
  Gene Name: leukocyte immunoglobulin-like receptor, subfamily A (with TM domain), member 1
  Uniprot ID: O75019
  ENST ID: ENST00000628480
  CDS Start-End: 255-1124
gaaaacccacaatccagtgtcaagaaagaagtcaacttttcttcccctatttccctgcatttctcctctgtgctcactgccacacgcagctcaacctgagctacacagccagatgcgagatgcttctctgctgatctgagtctgcctgcagcatggaccttggtcttccctgaagcatctccagggctggagggacgactgccatgcaccgagggctcatccatccgcagagcagggcagtgggaggagacgctatgacccccatcgtcacagtcctgatctgtctcaggctgagtctgggcccccggacccacgtgcaggcagggaccctccccaagcccacactctgggctgagccaggctctgtgatcacccaggggagtcccgtgaccctctggtgtcaggggatcctggagacccaggagtaccgtctgtatagagaaaagaaaacagcaccctggattacacggatcccacaggagattgtgaagaagggccagttccccatcccatccatcacctgggaacacacagggcggtatcgctgtttctacggtagccacactgcaggctggtcagagcccagtgaccccctggagctggtggtgacaggagcctacatcaaacccaccctctcagctctacccagccctgtggtgacctcaggagggaacgtgaccctccattgtgtctcacaggtggcatttggcagcttcattctgtgtaaggaaggagaagatgaacacccacaatgcctgaactcacagccccgtacccatgggtggtcccgggccatcttctctgtgggccccgtgagcccgagtcgcaggtggtcgtacaggtgctatgcttatgactcgaactctccccatgtgtggtctctacccagtgatctcctggagctcctggtcctaggagcagctgagaccctcagcccaccacaaaacaagtccgattccaaggctggagcagctaacaccctcagcccatcacaaaacaagactgcctcacacccccaggattacacagtggagaatctcatccgcatgggcatagctggcttggtcctggtggtcctcgggattctgctatttgaggctcagcacagccagagaagcctctgagatgcagccgggaggtgaacagcagagagaagaatgtacccttcagagtggtggagccttgggaacagatctgatgatgccaggaggttccgggagacaatttagggctgatgctatctggactgtctgccaatcatttttagagggaggaatcagtgttggattgcagagacattttctggagtgatccatgaaggaccattaacctgtgatacctttcctctctattaatgttgacttcccttggttggatcctcttctttccccacccccagacagacatgaggctacatcccacatggcagcgttgggtccacacctctgcacatctgtgtgctctggtccatggtgtgtaacacagtcttctttattactcattgccatactccctggtgtgctttactgagcctccatctcttcaattcagagttccaaacgtgcttcagtaactaaatcaatgggagagtatcggatttcaaccaggaaaagataaatccaccctgatgccctgacaccctctctgaaccctacgagcccttccctccttctcacatgctacctgtgcagcttctccttagatcattgtgtaaccatcactgccatcctgttccacacatggtcatcaccctacacccattcagcagccactccccattccctcttccctccagcacctgctaaccacaaatgtgctttctgtctctacggatttgcctattctgtctgaaaacatttcaatctcctttgacctgtgagctcctcacttcgagacttcctgcctttccaggcagaaccaaagtacaccacgtcaaaagcaatgataggcatttgcagtgtgttggtgatccacgaaaggaaaatcacggaagcaggatagaaatccagctgcagacaagacctcaggtcgatgaatcttgacaagcagttgagctgtttttttctactcacctaggacagtcaggcagaagtatgcaaaatgactggggctgattcttttctgaattgtcgcaaacagcaagaggacttgagtcctagcattaaagagttcaacatgtctaggtccaagaccactgttgtgtttgaaggatgtaaaaccctgctgcataggatggaatatttggagggaggatcctgaaaaacatgagggatcaaatagtcctcaactttctaggacaaagggagcagctatttgccatctaccctccagaataaagaaatcttatcattcaccatctaccctctagaataaagaaatcttatcattcgccatctaccctgtagaataaagaaatcttatcattcaccgtctaccctctagagtaaacaaatcttatcattcaccatctaccctctagaataaagaaatcttatcattcgccatctaccctctagaataaagaaatcttatcattcaccgtctaccctctagagtaaacaaatcttatcattcgccatctaccctctagaatagagaaatcttatcattcatcatctaccctccagaataaagaaatgttatcatttgccatctaccctctagaataaagaaatcttattaaggaca

SEQ ID NO: 148497 - DNA, 4429 bp, Homo sapiens
  Payload ID: 9411
  Gene Symbol: LILRA2
  Gene Name: leukocyte immunoglobulin-like receptor, subfamily A (with TM domain), member 2
  Uniprot ID: Q8N149
  ENST ID: ENST00000251376
  CDS Start-End: 88-1488
ccgagtgtccacaccctgtgcgtctctctgtcctgccagcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgacctcaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccctggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctatgaatgttgacttcccttgactggatcccctttttttcccatccccagacatgaggctccatcccacatggcaccgttgggtccacacctccacacacctgtgtgctctggtccacggcatgtgacacagtcttccttattcctcattgtcacactccttgatgtcacttactgagtccccgtctcttcagttcagagatccaaacctgaaccaccaactaaatcaacgacaggagatcagattccaaccaggaaaacataaatccaccctgctgccctgacaccctctctgtaccttatgagcccttccctctttctcagatgctatctgtgtaatttctcctgaaatatcaccacttggaatcatcacactggcatttcaagtgacaccacagctatgctgattcagaaaaagacatctctaaaatactgtaattagtggtatctaccaatttctgtgacataaatatttttctcatggcccaaatcaaggtgccaatgggttctcactgaatacagggttgggaagcaagggacagaactgtcttcactaatgagcaccagggacctgtggcacatcccactgagagctcacccatatacctacagtcctttctatttcagaggcaatgatcacttctacttcagtgttatggcacaggtcaaatgaaattctgacactgttatcctagcatatccacaaaagacaaacctattaatatctgatgtgggagataacacggctcacctaaaaatcaaagtacatgccgggcgcggtggctcacgcctgtaatcccagcactttgggaggccaaggcaggcagatcacgaggtcaggagatctagaccatcctggctaacatggtgaaaccccgtctctactaaatacacaaaaaaatattggccgggcgtggtggtgggcgcctgtagtcccagctactcaggaggctgaggcaggagaatggcgtgaacctgggaggcggagcttgcaatgggccgagattgcgacactgccctccagcctgggcgacagagcaagactccgtctcaaaaaaaaaaaaaaatccaagtacaacataagaaaaatgttaacagaactatgcagtttcgatgaaagaattttttttgagatggagttttgctttgttgcccaggctggagtgcaatggtgcaatctcggctcactgcaacctccacttcccaggttcaagcaattctcctgcctctgcctcccgagttactggactacaggtgtgcaccaccattcccggctattttttgtatttttagtagagacgggggtctcgccatgttagtgaggctggtcttgaactcctgacctcaggttatccacctgcctcagcctcccagagtgctgggattacaggtgtaagccactgtgcccggctgatggaagaattcttaaatgactcgttctactttctgctggtccaggcactccttggcttggggcagcatcccaccagtttctgcctccatcttctcaatgcttacacctacctggttgcctctgtcttcacacccattcttctgtgtgtgtcttttctcttcttcagattatgatatcactcagatcagattaggactcatcctaattcgttatgatcccttgatcataacttaaatgcatttgcaaagactctatttccaactatgttcacatttatagctaatggggctcaggatttcaacgtgtatattagggggaacaagtcaatttatgacagtgtctacaagaaaagtatgcatagaaatacatttaaccaaatacaaaaattaggtgggtgtggtggtacacgcctgtaatcccagctactcaggaggctgagacaggagaatcgcgtcaacccaggaaacagaggttgcagtgagctgagatcttgccattgcactccagcctgggcaacagagtgagactctgtctcaaaaaaagagaaatacatttaaccaaagagatgcaatacgtatacattgacaattttaaaatactgctcaaagaaataacaaaagacctaaatgaggaaaaagtcatcccagtatcataaatcaaaaggcttaaaattagttatctccctctagggaacctagactaatacactcaccccgtctccttgttcggaggctctcctgcctatcagcttttctcctctgtgctttccatgtccctgtggttctctggtgagccccatcatgctgtcctagaagatccacttagaatttcggtatttactcaccattttgactcctcttaacgagacaggcacatgccagctgtttccattcatccaacctgaacctgagcccccgatcattttttctaccacttttcagtcctgggaaactcagtcccaatgtgcttgtcattcatttgagaataattttcattttctccagtagttttaaaattactttgtatctattctagatatcgtttgctctatcatagttaagacattaatgttatttatgaatttgtgcacattaaactcatgatctttcatttctgtaaaaatgtcaactatttcctttgcaagtatttattgactaacatactccttatttccttcattctgaaagtgtgacacatagagatatatctgtttcctcttctcactctattctttgtgtgcattaattatcttttctatttttttcatttctagtttttctccgatgactaatgaaaaatttaataaatattctacaccaa

SEQ ID NO: 148498 - DNA, 1799 bp, Homo sapiens
  Payload ID: 9411
  Gene Symbol: LILRA2
  Gene Name: leukocyte immunoglobulin-like receptor, subfamily A (with TM domain), member 2
  Uniprot ID: Q8N149
  ENST ID: ENST00000251377
  CDS Start-End: 134-1585
gcgtctctgctgatctgagtctaactgcagcatggacctgggttttccctgaagcatctccagggctggagggacgaccgccatgcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgacctcaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccctggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagaagcagctgagaccctcagcccatcacaaaacaagacagactccacgactacatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctatgaa

SEQ ID NO: 148499 - DNA, 1452 bp, Homo sapiens
  Payload ID: 9411
  Gene Symbol: LILRA2
  Gene Name: leukocyte immunoglobulin-like receptor, subfamily A (with TM domain), member 2
  ENST ID: ENST00000391737
  CDS Start-End: 39-1403
tcatccatccgcagagcagggcagtgggaggagacgccatgacccccatcctcacggtcctgatctgtctcgggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgacctcaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccctggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggaca

SEQ ID NO: 148500 - DNA, 1753 bp, Homo sapiens
  Payload ID: 9411
  Gene Symbol: LILRA2
  Gene Name: leukocyte immunoglobulin-like receptor, subfamily A (with TM domain), member 2
  Uniprot ID: Q8N149
  ENST ID: ENST00000391738
  CDS Start-End: 90-1541
ctccgagtgtccacaccctgtgcgtctctctgtcctgccagcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgacctcaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccctggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagaagcagctgagaccctcagcccatcacaaaacaagacagactccacgactacatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctatg

SEQ ID NO: 148501 - DNA, 1571 bp, Homo sapiens
  Payload ID: 9411
  Gene Symbol: LILRA2
  Gene Name: leukocyte immunoglobulin-like receptor, subfamily A (with TM domain), member 2
  ENST ID: ENST00000439534
  CDS Start-End: 590-1571
ggctggaatgctaaggggtgatcatagctccctgcagcctccgcctcccaggccgaagtattcctcccacctcagcctcctgagtagctgggactagagatgtgagctgccatgcctggctaattttttgctttttttatacagacaaggtcttgctatgtggcccagggtaatctgaagctcctggcctctagccttcacccacctcagcctcctgaagtgctgggattccaggcatgagccaccatggtagaccctgcattactcctctgtgctcactgccacacgcagctcaacctgagctacacagccaggtgtcaggtgcgtctctgctgatctgagtctaactgcagcatggacctgggttttccctgaagcatctccagggctggagggacgaccgccatgccctaaaggtatgacagccaggctcctgagagggcagttgcacttcctgtgtggttgcacataacaaaaccccatgacaagaaggatccagcctccgagtgtccacaccctgtgcgtctctctgtcctgccagcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgacctcaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccctggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcgg

SEQ ID NO: 148502 - DNA, 644 bp, Homo sapiens
  Payload ID: 9411
  Gene Symbol: LILRA2
  Gene Name: leukocyte immunoglobulin-like receptor, subfamily A (with TM domain), member 2
  ENST ID: ENST00000472992
  CDS Start-End: 1-256
gtctctccccagtgaccccctggagctcgtggtctcagagcccctgagtataagcccttcacccacacctgcggggtccctgggccatctcaagacaagagaggaggctgcttgggcctcggtgggatctgactgtgatgaggctggagtccaccccagatgtgctcctttagagagaagcaccccagctgtgggtgccgctcacactgcccctcctgtgctcacctggaggcctctgtgctcagggcatccctgagaataaggaggggccctgcacctgctccctggacaagtcagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacattt

SEQ ID NO: 148503 - DNA, 2046 bp, Homo sapiens
  Payload ID: 9411
  Gene Symbol: LILRA2
  Gene Name: leukocyte immunoglobulin-like receptor, subfamily A (with TM domain), member 2
  ENST ID: ENST00000612908
  CDS Start-End: 470-1942
actctgtcactgaggctggaatgctaaggggtgatcatagctccctgcagcctccgcctcccaggccgaagtattcctcccacctcagcctcctgagtagctgggactagagatgtgagctgccatgcctggctaattttttgctttttttatacagacaaggtcttgctatgtggcccagggtaatctgaagctcctggcctctagccttcacccacctcagcctcctgaagtgctgggattccaggcatgagccaccatggtagaccctgcattactcctctgtgctcactgccacacgcagctcaacctgagctacacagccaggtgtcaggtgcgtctctgctgatctgagtctaactgcagcatggacctgggttttccctgaagcatctccagggctggagggacgaccgccatgcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccctggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagagcccctgagtataagcccttcacccacacctgcggggtccctgggccatctcaagacaagagaggaggctgcttgggcctcggtgggatctgactgtgatgaggctggagtccaccccagatgtgctcctttagagagaagcaccccagctgtgggtgccgctcacactgcccctcctgtgctcacctggaggcctctgtgctcagggcatccctgagaataaggaggggccctgcacctgctccctggacaagtcaccctaggccaacacccccaggattacacagtggagaatctcatccgcatgggtgtggctggctt

SEQ ID NO: 148504 - DNA, 1799 bp, Homo sapiens
  Payload ID: 9411
  Gene Symbol: LILRA2
  Gene Name: leukocyte immunoglobulin-like receptor, subfamily A (with TM domain), member 2
  Uniprot ID: Q8N149
  ENST ID: ENST00000611940
  CDS Start-End: 134-1585
gcgtctctgctgatctgagtctaactgcagcatggacctgggttttccctgaagcatctccagggctggagggacgaccgccatgcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccccggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagaagcagctgagaccctcagcccatcacaaaacaagacagactccacgactacatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctatgaa

SEQ ID NO: 148505 - DNA, 2330 bp, Homo sapiens
  Payload ID: 9411
  Gene Symbol: LILRA2
  Gene Name: leukocyte immunoglobulin-like receptor, subfamily A (with TM domain), member 2
  ENST ID: ENST00000612001
  CDS Start-End: 470-1942
actctgtcactgaggctggaatgctaaggggtgatcatagctccctgcagcctccgcctcccaggccgaagtattcctcccacctcagcctcctgagtagctgggactagagatgtgagctgccatgcctggctaattttttgctttttttatacagacaaggtcttgctatgtggcccagggtaatctgaagctcctggcctctagccttcacccacctcagcctcctgaagtgctgggattccaggcatgagccaccatggtagaccctgcattactcctctgtgctcactgccacacgcagctcaacctgagctacacagccaggtgtcaggtgcgtctctgctgatctgagtctaactgcagcatggacctgggttttccctgaagcatctccagggctggagggacgaccgccatgcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccctggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagagcccctgagtataagcccttcacccacacctgcggggtccctgggccatctcaagacaagagaggaggctgcttgggcctcggtgggatctgactgtgatgaggctggagtccaccccagatgtgctcctttagagagaagcaccccagctgtgggtgccgctcacactgcccctcctgtgctcacctggaggcctctgtgctcagggcatccctgagaataaggaggggccctgcacctgctccctggacaagtcagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacattt

SEQ ID NO: 148506 - DNA, 1702 bp, Homo sapiens
  Payload ID: 9411
  Gene Symbol: LILRA2
  Gene Name: leukocyte immunoglobulin-like receptor, subfamily A (with TM domain), member 2
  Uniprot ID: Q8N149
  ENST ID: ENST00000613573
  CDS Start-End: 88-1488
ccgagtgtccacaccctgtgcgtctctctgtcctgccagcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccccggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctatgaa

SEQ ID NO: 148507 - DNA, 1452 bp, Homo sapiens
  Payload ID: 9411
  Gene Symbol: LILRA2
  Gene Name: leukocyte immunoglobulin-like receptor, subfamily A (with TM domain), member 2
  ENST ID: ENST00000615591
  CDS Start-End: 39-1403
tcatccatccgcagagcagggcagtgggaggagacgccatgacccccatcctcacggtcctgatctgtctcgggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccctggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggaca

SEQ ID NO: 148508 - DNA, 1571 bp, Homo sapiens
  Payload ID: 9411
  Gene Symbol: LILRA2
  Gene Name: leukocyte immunoglobulin-like receptor, subfamily A (with TM domain), member 2
  ENST ID: ENST00000618818
  CDS Start-End: 590-1571
ggctggaatgctaaggggtgatcatagctccctgcagcctccgcctcccaggccgaagtattcctcccacctcagcctcctgagtagctgggactagagatgtgagctgccatgcctggctaattttttgctttttttatacagacaaggtcttgctatgtggcccagggtaatctgaagctcctggcctctagccttcacccacctcagcctcctgaagtgctgggattccaggcatgagccaccatggtagaccctgcattactcctctgtgctcactgccacacgcagctcaacctgagctacacagccaggtgtcaggtgcgtctctgctgatctgagtctaactgcagcatggacctgggttttccctgaagcatctccagggctggagggacgaccgccatgccctaaaggtatgacagccaggctcctgagagggcagttgcacttcctgtgtggttgcacataacaaaaccccatgacaagaaggatccagcctccgagtgtccacaccctgtgcgtctctctgtcctgccagcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccccggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcgg

SEQ ID NO: 148509 - DNA, 1705 bp, Homo sapiens
  Payload ID: 9411
  Gene Symbol: LILRA2
  Gene Name: leukocyte immunoglobulin-like receptor, subfamily A (with TM domain), member 2
  Uniprot ID: Q8N149
  ENST ID: ENST00000617409
  CDS Start-End: 40-1491
ctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccctggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagaagcagctgagaccctcagcccatcacaaaacaagacagactccacgactacatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctatgaa

SEQ ID NO: 148510 - DNA, 1452 bp, Homo sapiens
  Payload ID: 9411
  Gene Symbol: LILRA2
  Gene Name: leukocyte immunoglobulin-like receptor, subfamily A (with TM domain), member 2
  ENST ID: ENST00000621611
  CDS Start-End: 39-1403
tcatccatccgcagagcagggcagtgggaggagacgccatgacccccatcctcacggtcctgatctgtctcgggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccccggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggaca

SEQ ID NO: 148511 - DNA, 644 bp, Homo sapiens; identical to SEQ ID NO: 148502
  Payload ID: 9411
  Gene Symbol: LILRA2
  Gene Name: leukocyte immunoglobulin-like receptor, subfamily A (with TM domain), member 2
  ENST ID: ENST00000617156
  CDS Start-End: 1-256

SEQ ID NO: 148512 - DNA, 1725 bp, Homo sapiens
  Payload ID: 9411
  Gene Symbol: LILRA2
  Gene Name: leukocyte immunoglobulin-like receptor, subfamily A (with TM domain), member 2
  Uniprot ID: Q8N149
  ENST ID: ENST00000620279
  CDS Start-End: 124-1524
acataacaaaaccccatgacaagaaggatccagcctccgagtgtccacaccctgtgcgtctctctgtcctgccagcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccctggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacattt

SEQ ID NO: 148513 - DNA, 1753 bp, Homo sapiens
  Payload ID: 9411
  Gene Symbol: LILRA2
  Gene Name: leukocyte immunoglobulin-like receptor, subfamily A (with TM domain), member 2
  Uniprot ID: Q8N149
  ENST ID: ENST00000616629
  CDS Start-End: 90-1541
ctccgagtgtccacaccctgtgcgtctctctgtcctgccagcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccccggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagaagcagctgagaccctcagcccatcacaaaacaagacagactccacgactacatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtctatg

SEQ ID NO: 148514 - DNA, 1705 bp, Homo sapiens; identical to SEQ ID NO: 148509
  Payload ID: 9411
  Gene Symbol: LILRA2
  Gene Name: leukocyte immunoglobulin-like receptor, subfamily A (with TM domain), member 2
  Uniprot ID: Q8N149
  ENST ID: ENST00000622640
  CDS Start-End: 40-1491

SEQ ID NO: 148515 - DNA, 1732 bp, Homo sapiens
  Payload ID: 9411
  Gene Symbol: LILRA2
  Gene Name: leukocyte immunoglobulin-like receptor, subfamily A (with TM domain), member 2
  Uniprot ID: Q8N149
  ENST ID: ENST00000621721
  CDS Start-End: 124-1524
acataacaaaaccccatgacaagaaggatccagcctccgagtgtccacaccctgtgcgtctctctgtcctgccagcactgagggctcatccatccgcagagcagggcagtgggaggagacgccatgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagtacagtgaccccctggagctggtggtgacaggagcctacagcaaacccaccctctcagctctgcccagccctgtggtgaccttaggagggaacgtgaccctccagtgtgtctcacaggtggcatttgacggcttcattctgtgtaaggaaggagaagatgaacacccacaacgcctgaactcccattcccatgcccgtgggtggtcctgggccatcttctccgtgggccccgtgagcccgagtcgcaggtggtcgtacaggtgctatgcttatgactcgaactctccctatgtgtggtctctacccagtgatctcctggagctcctggtcccaggtgtttctaagaagccatcactctcagtgcagccaggtcctatggtggcccctggggagagcctgaccctccagtgtgtctctgatgtcggctacgacagatttgttctgtataaggagggagaacgtgacttcctccagcgccctggttggcagccccaggctgggctctcccaggccaacttcaccctgggccctgtgagcccctcccacgggggccagtacagatgctacagtgcacacaacctctcctccgagtggtcggcccccagtgaccccctggacatcctgatcacaggacagttctatgacagaccctctctctcggtgcagccggtccccacagtagccccaggaaagaacgtgaccctgctgtgtcagtcacgggggcagttccacactttccttctgaccaaggagggggcaggccatcccccactgcatctgagatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggacagatctgatgatcccaggaggctctggaggacaatctaggacctacattatctggactgtatgctggtcatttctagagacagcaatcaatatttgagtgtaaggaaactgtctggggtgattcctagaagatcattaaactgtggtacatttttttgtc

SEQ ID NO: 148516 - DNA, 661 bp, Homo sapiens
  Payload ID: 9411
  Gene Symbol: LILRA2
  Gene Name: leukocyte immunoglobulin-like receptor, subfamily A (with TM domain), member 2
  ENST ID: ENST00000631297
  CDS Start-End: 1-612
atgacccccatcctcacggtcctgatctgtctcgggctgagtctgggccccaggacccacgtgcaggcagggcacctccccaagcccaccctctgggctgagccaggctctgtgatcatccagggaagtcctgtgaccctcaggtgtcaggggagccttcaggctgaggagtaccatctatatagggaaaacaaatcagcatcctgggttagacggatacaagagcctgggaagaatggccagttccccatcccatccatcacctgggaacacgcagggcggtatcactgtcagtactacagccacaatcactcatcagagcaccaagctcagcagaaccaggctgaattccgcatgggtcctgtgacctcagcccacgtggggacctacagatgctacagctcactcagctccaacccctacctgctgtctctccccagtgaccccctggagctcgtggtctcagcatccctaggccaacacccccaggattacacagtggagaatctcatccgcatgggtgtggctggcttggtcctggtggtcctcgggattctgctatttgaggctcagcacagccagagaagcctacaagatgcagccgggaggtgaacagcagagaggacaatgcatccttcagcgtggtggagcctcagggaca

SEQ ID NO: 148517 - DNA, 661 bp, Homo sapiens; identical to SEQ ID NO: 148516
  Payload ID: 9411
  Gene Symbol: LILRA2
  Gene Name: leukocyte immunoglobulin-like receptor, subfamily A (with TM domain), member 2
  ENST ID: ENST00000627076
  CDS Start-End: 1-612

SEQ ID NO: 148518 - DNA, 661 bp, Homo sapiens; identical to SEQ ID NO: 148516
  Payload ID: 9411
  Gene Symbol: LILRA2
  Gene Name: leukocyte immunoglobulin-like receptor, subfamily A (with TM domain), member 2
  ENST ID: ENST00000629481
  CDS Start-End: 1-612

SEQ ID NO: 148519 - DNA, 1452 bp, Homo sapiens; identical to SEQ ID NO: 148507
  Payload ID: 9411
  Gene Symbol: LILRA2
  Gene Name: leukocyte immunoglobulin-like receptor, subfamily A (with TM domain), member 2
  ENST ID: ENST00000628662
  CDS Start-End: 39-1403

SEQ ID NO: 148520 - DNA, 661 bp, Homo sapiens; identical to SEQ ID NO: 148516
  Payload ID: 9411
  Gene Symbol: LILRA2
  Gene Name: leukocyte immunoglobulin-like receptor, subfamily A (with TM domain), member 2
  ENST ID: ENST00000628510
  CDS Start-End: 1-612

SEQ ID NO: 148521 - DNA, 1944 bp, Homo sapiens
  Payload ID: 9412
  Gene Symbol: LILRA4
  Gene Name: leukocyte immunoglobulin-like receptor, subfamily A (with TM domain), member 4
  Uniprot ID: P59901
  ENST ID: ENST00000291759
  CDS Start-End: 58-1557
ctacgggcaccgtggccacacctgcctgcacagccagggccaggaggaggagatgccatgaccctcattctcacaagcctgctcttctttgggctgagcctgggccccaggacccgggtgcaggcagaaaacctactcaaacccatcctgtgggccgagccaggtcccgtgatcacctggcataaccccgtgaccatctggtgtcagggcaccctggaggcccaggggtaccgtctggataaagagggaaactcaatgtcgaggcacatattaaaaacactggagtctgaaaacaaggtcaaactctccatcccatccatgatgtgggaacatgcagggcgatatcactgttactatcagagccctgcaggctggtcagagcccagcgaccccctggagctggtggtgacagcctacagcagacccaccctgtccgcactgccaagccctgtggtgacctcaggagtgaacgtgaccctccggtgtgcctcacggctgggactgggcaggttcactctgattgaggaaggagaccacaggctctcctggaccctgaactcacaccaacacaaccatggaaagttccaggccctgttccccatgggccccctgaccttcagcaacaggggtacattcagatgctacggctatgaaaacaacaccccatacgtgtggtcggaacccagtgaccccctgcagctactggtgtcaggcgtgtctaggaagccctccctcctgaccctgcagggccctgtcgtgacccccggagagaatctgaccctccagtgtggctctgatgtcggctacatcagatacactctgtacaaggagggggccgatggcctcccccagcgccctggccggcagccccaggctgggctctcccaggccaacttcaccctgagccctgtgagccgctcctacgggggccagtacagatgctacggcgcacacaacgtctcctccgagtggtcggcccccagtgaccccctggatatcctgatcgcaggacagatctctgacagaccctccctctcagtgcagccgggccccacggtgacctcaggagagaaggtgaccctgctgtgtcagtcatgggacccgatgttcactttccttctgaccaaggagggggcagcccatcccccgttgcgtctgagatcaatgtacggagctcataagtaccaggctgaattccccatgagtcctgtgacctcagcccacgcggggacctacaggtgctacggctcacgcagctccaacccctacctgctgtctcaccccagtgagcccctggagctcgtggtctcaggagcaactgagaccctcaatccagcacaaaagaagtcagattccaagactgccccacacctccaggattacacagtggagaatctcatccgcatgggtgtggctggcttggtcctgctgttcctcgggattctgttatttgaggctcagcacagccagagaagccccccaaggtgcagccaggaggcaaacagcagaaaggacaatgcacccttcagagtggtggagccttgggaacagatctgatgatctgaggaggttctggaagactggggcagcagttggggaagtgtctgctgagaatatcaaggggaagaagcatgggtcaggtgcaggaagatgtctgggtgtctgtagaagatgcttcctccattaaactgtggtgctttcctcctcattgtcgactctccttgactgccccttccttcgtttttcttccctatgatgtaaggcttcacccctatggtgggtttgggtccgcccctctgtgacctcatgctctgctccactttcaggtaatacacctttctttatttctaactactgcattttctaatgtgtattactgggactatctcttcagctcataacatggaatttgcttttgataattaaatccatgggcaaaaatca

SEQ ID NO: 148522 - DNA, 421 bp, Homo sapiens
  Payload ID: 9412
  Gene Symbol: LILRA4
  Gene Name: leukocyte immunoglobulin-like receptor, subfamily A (with TM domain), member 4
  ENST ID: ENST00000595581
  CDS Start-End: 1-421
tcctccgagtggtcggcccccagtgaccccctggatatcctgatcgcaggacagatctctgacagaccctccctctcagtgcagccgggccccacggtgacctcaggagagaaggtgaccctgctgtgtcagtcatgggacccgatgttcactttccttctgaccaaggagggggcagcccatcccccgttgcgtctgagatcaatgtacggagctcataagtaccaggctgaattccccatgagtcctgtgacctcagcccacgcggggacctacaggtgctacggctcacgcagctccaacccctacctgctgtctcaccccagtgagcccctggagctcgtggtctcaggtgagggcgctgaccctgtccactctgagctcaaaggggttcttggaaatgaaaaaggagagcttccaa

SEQ ID NO: 148523 - DNA, 1707 bp, Homo sapiens
  Payload ID: 9412
  Gene Symbol: LILRA4
  Gene Name: leukocyte immunoglobulin-like receptor, subfamily A (with TM domain), member 4
  Uniprot ID: P59901
  ENST ID: ENST00000613813
  CDS Start-End: 58-1557
ctacgggcaccgtggccacacctgcctgcacagccagggccaggaggaggagatgccatgaccctcattctcacaagcctgctcttctttgggctgagcctgggccccaggacccgggtgcaggcagaaaacctacccaaacccatcctgtgggccgagccaggtcccgtgatcacctggcataaccccgtgaccatctggtgtcagggcaccctggaggcccaggggtaccgtctggataaagagggaaactcaatgtcgaggcacatattaaaaacactggagtctgaaaacaaggtcaaactctccatcccatccatgatgtgggaacatgcagggcgatatcactgttactatcagagccctgcaggctggtcagagcccagcgaccccctggagctggtggtgacagcctacagcagacccaccctgtccgcactgccaagccctgtggtgacctcaggagtgaacgtgaccctccggtgtgcctcacggctgggactgggcaggttcactctgattgaggaaggagaccacaggctctcctggaccctgaactcacaccaacacaaccatggaaagttccaggccctgttccccatgggccccctgaccttcagcaacaggggtacattcagatgctacggctatgaaaacaacaccccatacgtgtggtcggaacccagtgaccccctgcagctactggtgtcaggcgtgtctaggaagccctccctcctgaccctgcagggccctgtcgtgacccccggagagaatctgaccctccagtgtggctctgatgtcggctacatcagatacactctgtacaaggagggggccgatggcctcccccagcgccctggccggcagccccaggctgggctctcccaggccaacttcaccctgagccctgtgagccgctcctacgggggccagtacagatgctacggcgcacacaacgtctcctccgagtggtcggcccccagtgaccccctggacatcctgatcgcaggacagatctctgacagaccctccctctcagtgcagccgggccccacggtgacctcaggagagaaggtgaccctgctgtgtcagtcatgggacccgatgttcactttccttctgaccaaggagggggcagcccatcccccgttgcgtctgagatcaatgtacggagctcataagtaccaggctgaattccccatgagtcctgtgacctcagcccacgcggggacctacaggtgctacggctcacgcagctccaacccctacctgctgtctcaccccagtgagcccctggagctcgtggtctcaggagcaactgagaccctcaatccagcacaaaagaagtcagattccaagactgccccacacctccaggattacacagtggagaatctcatccgcatgggtgtggctggcttggtcctgctgttcctcgggattctgttatttgaggctcagcacagccagagaagccccccaaggtgcagccaggaggcaaacagcagaaaggacaatgcacccttcagagtggtggagccttgggaacagatctgatgatctgaggaggttctggaagactggggcagcagttggggaagtgtctgctgagaatatcaaggggaagaagcatgggtcaggtgcaggaagatgtctgggtgtctgtagaagatgcttcctccattaaactgtggtgctttcctcctc

SEQ ID NO: 148524 - DNA, 1607 bp, Homo sapiens
  Payload ID: 9412
  Gene Symbol: LILRA4
  Gene Name: leukocyte immunoglobulin-like receptor, subfamily A (with TM domain), member 4
  Uniprot ID: P59901
  ENST ID: ENST00000619832
  CDS Start-End: 77-1576
accatgtgtctgtctgtgtctacgggcaccgtggccacacctgcctgcacagccagggccaggaggaggagatgccatgaccctcattctcacaagcctgctcttctttgggctgagcctgggccccaggacccgggtgcaggcagaaaacctacccaaacccatcctgtgggccgagccaggtcccgtgatcacctggcataaccccgtgaccatctggtgtcagggcaccctggaggcccaggggtaccgtctggataaagagggaaactcaatgtcgaggcacatattaaaaacactggagtctgaaaacaaggtcaaactctccatcccatccatgatgtgggaacatgcagggcgatatcactgttactatcagagccctgcaggctggtcagagcccagcgaccccctggagctggtggtgacagcctacagcagacccaccctgtccgcactgccaagccctgtggtgacctcaggagtgaacgtgaccctccggtgtgcctcacggctgggactgggcaggttcactctgattgaggaaggagaccacaggctctcctggaccctgaactcacaccaacacaaccatggaaagttccaggccctgttccccatgggccccctgaccttcagcaacaggggtacattcagatgctacggctatgaaaacaacaccccatacgtgtggtcggaacccagtgaccccctgcagctactggtgtcaggcgtgtctaggaagccctccctcctgaccctgcagggccctgtcgtgacccccggagagaatctgaccctccagtgtggctctgatgtcggctacatcagatacactctgtacaaggagggggccgatggcctcccccagcgccctggccggcagccccaggctgggctctcccaggccaacttcaccctgagccctgtgagccgctcctacgggggccagtacagatgctacggcgcacacaacgtctcctccgagtggtcggcccccagtgaccccctggacatcctgatcgcaggacagatctctgacagaccctccctctcagtgcagccgggccccacggtgacctcaggagagaaggtgaccctgctgtgtcagtcatgggacccgatgttcactttccttctgaccaaggagggggcagcccatcccccgttgcgtctgagatcaatgtacggagctcataagtaccaggctgaattccccatgagtcctgtgacctcagcccacgcggggacctacaggtgctacggctcacgcagctccaacccctacctgctgtctcaccccagtgagcccctggagctcgtggtctcaggagcaactgagaccctcaatccagcacaaaagaagtcagattccaagactgccccacacctccaggattacacagtggagaatctcatccgcatgggtgtggctggcttggtcctgctgttcctcgggattctgttatttgaggctcagcacagccagagaagccccccaaggtgcagccaggaggcaaacagcagaaaggacaatgcacccttcagagtggtggagccttgggaacagatctgatgatctgaggaggttctggaagactggggca

SEQ ID NO: 148525 - DNA, 1647 bp, Homo sapiens
  Payload ID: 9412
  Gene Symbol: LILRA4
  Gene Name: leukocyte immunoglobulin-like receptor, subfamily A (with TM domain), member 4
  ENST ID: ENST00000620539
  CDS Start-End: 58-1260
ctacgggcaccgtggccacacctgcctgcacagccagggccaggaggaggagatgccatgaccctcattctcacaagcctgctcttctttgggctgagcctgggccccaggacccgggtgcaggcagaaaacctacccaaacccatcctgtgggccgagccaggtcccgtgatcacctggcataaccccgtgaccatctggtgtcagggcaccctggaggcccaggggtaccgtctggataaagagggaaactcaatgtcgaggcacatattaaaaacactggagtctgaaaacaaggtcaaactctccatcccatccatgatgtgggaacatgcagggcgatatcactgttactatcagagccctgcaggctggtcagagcccagcgaccccctggagctggtggtgacagcctacagcagacccaccctgtccgcactgccaagccctgtggtgacctcaggagtgaacgtgaccctccggtgtgcctcacggctgggactgggcaggttcactctgattgaggaaggagaccacaggctctcctggaccctgaactcacaccaacacaaccatggaaagttccaggccctgttccccatgggccccctgaccttcagcaacaggggtacattcagatgctacggctatgaaaacaacaccccatacgtgtggtcggaacccagtgaccccctgcagctactggtgtcaggacagatctctgacagaccctccctctcagtgcagccgggccccacggtgacctcaggagagaaggtgaccctgctgtgtcagtcatgggacccgatgttcactttccttctgaccaaggagggggcagcccatcccccgttgcgtctgagatcaatgtacggagctcataagtaccaggctgaattccccatgagtcctgtgacctcagcccacgcggggacctacaggtgctacggctcacgcagctccaacccctacctgctgtctcaccccagtgagcccctggagctcgtggtctcaggagcaactgagaccctcaatccagcacaaaagaagtcagattccaagactgccccacacctccaggattacacagtggagaatctcatccgcatgggtgtggctggcttggtcctgctgttcctcgggattctgttatttgaggctcagcacagccagagaagccccccaaggtgcagccaggaggcaaacagcagaaaggacaatgcacccttcagagtggtggagccttgggaacagatctgatgatctgaggaggttctggaagactggggcagcagttggggaagtgtctgctgagaatatcaaggggaagaagcatgggtcaggtgcaggaagatgtctgggtgtctgtagaagatgcttcctccattaaactgtggtgctttcctcctcattgtcgactctccttgactgccccttccttcgtttttcttccctatgatgtaaggcttcacccctatggtgggtttgggtccgcccctctgtgacctcatgctctgctccactttcaggtaatacacctttctttatttctaactactgcattttctaatgtgtattactgggactatctcttcagctcataacatggaatttgcttttgataattaaatccatgggcaaaaatca

SEQ ID NO: 148526 - DNA, 1588 bp, Homo sapiens
  Payload ID: 9412
  Gene Symbol: LILRA4
  Gene Name: leukocyte immunoglobulin-like receptor, subfamily A (with TM domain), member 4
  Uniprot ID: P59901
  ENST ID: ENST00000616790
  CDS Start-End: 58-1557
ctacgggcaccgtggccacacctgcctgcacagccagggccaggaggaggagatgccatgaccctcattctcacaagcctgctcttctttgggctgagcctgggccccaggacccgggtgcaggcagaaaacctacccaaacccatcctgtgggccgagccaggtcccgtgatcacctggcataaccccgtgaccatctggtgtcagggcaccctggaggcccaggggtaccgtctggataaagagggaaactcaatgtcgaggcacatattaaaaacactggagtctgaaaacaaggtcaaactctccatcccatccatgatgtgggaacatgcagggcgatatcactgttactatcagagccctgcaggctggtcagagcccagcgaccccctggagctggtggtgacagcctacagcagacccaccctgtccgccctgccaagccctgtggtaacctcaggagtgaacgtgaccctccggtgtgcctcacggctgggactgggcaggttcactctgattgaggaaggagaccacaggctctcctggaccctgaactcacaccaacacaaccatggaaagttccaggccctgttccccatgggccccctgaccttcagcaacaggggtacattcagatgctacggctatgaaaacaacaccccatacgtgtggtcggaacccagtgaccccctgcagctactggtgtcaggcgtgtctaggaagccctccctcctgaccctgcagggccctgtcgtgacccccggagagaatctgaccctccagtgtggctctgatgtcggctacatcagatacactctgtacaaggagggggccgatggcctcccccagcgccctggccggcagccccaggctgggctctcccaggccaacttcaccctgagccctgtgagccgctcctacgggggccagtacagatgctacggcgcacacaacgtctcctccgagtggtcggcccccagtgaccccctggacatcctgatcgcaggacagatctctgacagaccctccctctcagtgcagccgggccccacggtgacctcaggagagaaggtgaccctgctgtgtcagtcatgggacccgatgttcactttccttctgaccaaggagggggcagcccatcccccgttgcgtctgagatcaatgtacggagctcataagtaccaggctgaattccccatgagtcctgtgacctcagcccacgcggggacctacaggtgctacggctcacgcagctccaacccctacctgctgtctcaccccagtgagcccctggagctcgtggtctcaggagcaactgagaccctcaatccagcacaaaagaagtcagattccaagactgccccacacctccaggattacacagtggagaatctcatccgcatgggtgtggctggcttggtcctgctgttcctcgggattctgttatttgaggctcagcacagccagagaagccccccaaggtgcagccaggaggcaaacagcagaaaggacaatgcacccttcagagtggtggagccttgggaacagatctgatgatctgaggaggttctggaagactggggca

SEQ ID NO: 148527 - DNA, 1363 bp, Homo sapiens
  Payload ID: 9413
  Gene Symbol: LILRA5
  Gene Name: leukocyte immunoglobulin-like receptor, subfamily A (with TM domain), member 5
  Uniprot ID: A6NI73
  ENST ID: ENST00000432233
  CDS Start-End: 121-1020
atgcagctcagcctgggctacacagccaggtgtcagatgtgtctctgctgatctgagtctgcctgtggcatggacctgcatcttccctgaagcatctccagggctgaaaaatcactgaccatggcaccatggtctcatccatctgcacagctgcagccagtgggaggagacgccgtgagccctgccctcatggttctgctctgcctcgggctgagtctgggccccaggacccacgtgcaggcagggaacctctccaaagccaccctctgggctgagccaggctctgtgatcagccgggggaactctgtgaccatccggtgtcaggggaccctggaggcccaggaataccgtctggttaaagagggaagcccagaaccctgggacacacagaacccactggagcccaagaacaaggccagattctccatcccatccatgacagagcaccatgcagggagataccgctgttactactacagccctgcaggctggtcagagcccagcgaccccctggagctggtggtgacaggattctacaacaaacccaccctctcagccctgcccagtcctgtggtgacctcaggagagaacgtgaccctccagtgtggctcacggctgagattcgacaggttcattctgactgaggaaggagaccacaagctctcctggaccttggactcacagctgacccccagtgggcagttccaggccctgttccctgtgggccctgtgacccccagccacaggtggatgctcagatgctatggctctcgcaggcatatcctgcaggtatggtcagaacccagtgacctcctggagattccggtctcaggagcagctgataacctcagtccgtcacaaaacaagtctgactctgggactgcctcacaccttcaggattacgcagtagagaatctcatccgcatgggcatggccggcttgatcctggtggtccttgggattctgatatttcaggattggcacagccagagaagcccccaagctgcagctggaaggtgaacagaagagagaacaatgcaccattgaatgctggagccttggaagcgaatctgatggtcctaggaggttcgggaagaccatctgaggcctatgccatctggactgtctgctggcaatttctttttttctttcttttcttttctttcttttttttttttttttttttttttgagatggagtcttgctctgtcaccaggctggaatgcagtggcgcaatctgggctcactgcaacctccgcctctcgggttcaagtgattctcctgcctcagcctctggcaatttctagagggaggaatgggtgtttgagtgcagagacactggtctggggtgatccatggagga

SEQ ID NO: 148528 - DNA, 922 bp, Homo sapiens
  Payload ID: 9413
  Gene Symbol: LILRA5
  Gene Name: leukocyte immunoglobulin-like receptor, subfamily A (with TM domain), member 5
  Uniprot ID: A6NI73
  ENST ID: ENST00000621482
  CDS Start-End: 80-877
tctctgctgatctgagtctgcctgtggcatggacctgcatcttccctgaagcatctccagggctgaaaaatcactgaccatggcaccatggtctcatccatctgcacagctgcagccagtgggaggagacgccgtgagccctgccctcatggttctgctctgcctcgggctgagtctgggccccaggacccacgtgcaggcagggaacctctccaaagccaccctctgggctgagccaggctctgtgatcagccgggggaactctgtgaccatccggtgtcaggggaccctggaggcccaggaataccgtctggttaaagagggaagcccagaaccctgggacacacagaacccactggagcccaagaacaaggccagattctccatcccatccatgacagagcaccatgcagggagataccgctgttactactacagccctgcaggctggtcagagcccagcgaccccctggagctggtggtgacaggattctacaacaaacccaccctctcagccctgcccagtcctgtggtgacctcaggagagaacgtgaccctccagtgtggctcacggctgagattcgacaggttcattctgactgaggaaggagaccacaagctctcctggaccttggactcacagctgacccccagtgggcagttccaggccctgttccctgtgggccctgtgacccccagccacaggtggatgctcagatgctatggctctcgcaggcatatcctgcaggtatggtcagaacccagtgacctcctggagattccggtctcaggtgaggaagccacagtcttctctagtacaattcagggaagccagacaggttgtggagagctttacaggcagggcagcccctgctaagaaagacaaaaaggggaaggagaacacagaaatcctagggacaca

SEQ ID NO: 148529 - DNA, 1365 bp, Homo sapiens
  Payload ID: 9413
  Gene Symbol: LILRA5
  Gene Name: leukocyte immunoglobulin-like receptor, subfamily A (with TM domain), member 5
  Uniprot ID: A6NI73
  ENST ID: ENST00000618711
  CDS Start-End: 121-1020
atgcagctcagcctgggctacacagccaggtgtcagatgtgtctctgctgatctgagtctgcctgtggcatggacctgcatcttccctgaagcatctccagggctgaaaaatcactgaccatggcaccatggtctcatccatctgcacagctgcagccagtgggaggagacgccgtgagccctgccctcatggttctgctctgcctcgggctgagtctgggccccaggacccacgtgcaggcagggaacctctccaaagccaccctctgggctgagccaggctctgtgatcagccgggggaactctgtgaccatccggtgtcaggggaccctggaggcccaggaataccgtctggttaaagagggaagcccagaaccctgggacacacagaacccactggagcccaagaacaaggccagattctccatcccatccatgacagagcaccatgcagggagataccgctgttactactacagccctgcaggctggtcagagcccagcgaccccctggagctggtggtgacaggattctacaacaaacccaccctctcagccctgcccagtcctgtggtgacctcaggagagaacgtgaccctccagtgtggctcacggctgagattcgacaggttcattctgactgaggaaggagaccacaagctctcctggaccttggactcacagctgacccccagtgggcagttccaggccctgttccctgtgggccctgtgacccccagccacaggtggatgctcagatgctatggctctcgcaggcatatcctgcaggtatggtcagaacccagtgacctcctggagattccggtctcaggagcagctgataacctcagtccgtcacaaaacaagtctgactctgggactgcctcacaccttcaggattacgcagtagagaatctcatccgcatgggcatggccggcttgatcctggtggtccttgggattctgatatttcaggattggcacagccagagaagcccccaagctgcagctggaaggtgaacagaagagagaacaatgcaccattgaatgctggagccttggaagcgaatctgatggtcctaggaggttcgggaagaccatctgaggcctatgccatctggactgtctgctggcaatttctttttttctttcttttcttttctttcttttttttttttttttttttttttttgagatggagtcttgctctgtcaccaggctggaatgcagtggcgcaatctgggctcactgcaacctccgcctctcgggttcaagtgattctcctgcctcagcctctggcaatttctagagggaggaatgggtgtttgagtgcagagacactggtctggggtgatccatggagga

SEQ ID NO: 148530 - DNA, 1078 bp, Homo sapiens
  Payload ID: 9413
  Gene Symbol: LILRA5
  Gene Name: leukocyte immunoglobulin-like receptor, subfamily A (with TM domain), member 5
  Uniprot ID: A6NI73
  ENST ID: ENST00000615820
  CDS Start-End: 56-919
tggcatggacctgcatcttccctgaagcatctccagggctgaaaaatcactgaccatggcaccatggtctcatccatctgcacagctgcagccagtgggaggagacgccgtgagccctgccctcatggttctgctctgcctcgggaacctctccaaagccaccctctgggctgagccaggctctgtgatcagccgggggaactctgtgaccatccggtgtcaggggaccctggaggcccaggaataccgtctggttaaagagggaagcccagaaccctgggacacacagaacccactggagcccaagaacaaggccagattctccatcccatccatgacagagcaccatgcagggagataccgctgttactactacagccctgcaggctggtcagagcccagcgaccccctggagctggtggtgacaggattctacaacaaacccaccctctcagccctgcccagtcctgtggtgacctcaggagagaacgtgaccctccagtgtggctcacggctgagattcgacaggttcattctgactgaggaaggagaccacaagctctcctggaccttggactcacagctgacccccagtgggcagttccaggccctgttccctgtgggccctgtgacccccagccacaggtggatgctcagatgctatggctctcgcaggcatatcctgcaggtatggtcagaacccagtgacctcctggagattccggtctcaggagcagctgataacctcagtccgtcacaaaacaagtctgactctgggactgcctcacaccttcaggattacgcagtagagaatctcatccgcatgggcatggccggcttgatcctggtggtccttgggattctgatatttcaggattggcacagccagagaagcccccaagctgcagctggaaggtgaacagaagagagaacaatgcaccattgaatgctggagccttggaagcgaatctgatggtcctaggaggttcgggaagaccatctgaggcctatgccatctggactgtctgctggcaatttctttttttctttcttttcttttctttcttttttttttttt

SEQ ID NO: 148531 - DNA, 997 bp, Homo sapiens
  Payload ID: 9413
  Gene Symbol: LILRA5
  Gene Name: leukocyte immunoglobulin-like receptor, subfamily A (with TM domain), member 5
  Uniprot ID: A6NI73
  ENST ID: ENST00000619516
  CDS Start-End: 73-834
tgatctgagtctgcctgtggcatggacctgcatcttccctgaagcatctccagggctgaaaaatcactgaccatggcaccatggtctcatccatctgcacagctgcagccagtgggaggagacgccgtgagccctgccctcatggttctgctctgcctcgggaacctctccaaagccaccctctgggctgagccaggctctgtgatcagccgggggaactctgtgaccatccggtgtcaggggaccctggaggcccaggaataccgtctggttaaagagggaagcccagaaccctgggacacacagaacccactggagcccaagaacaaggccagattctccatcccatccatgacagagcaccatgcagggagataccgctgttactactacagccctgcaggctggtcagagcccagcgaccccctggagctggtggtgacaggattctacaacaaacccaccctctcagccctgcccagtcctgtggtgacctcaggagagaacgtgaccctccagtgtggctcacggctgagattcgacaggttcattctgactgaggaaggagaccacaagctctcctggaccttggactcacagctgacccccagtgggcagttccaggccctgttccctgtgggccctgtgacccccagccacaggtggatgctcagatgctatggctctcgcaggcatatcctgcaggtatggtcagaacccagtgacctcctggagattccggtctcaggtgaggaagccacagtcttctctagtacaattcagggaagccagacaggttgtggagagctttacaggcagggcagcccctgctaagaaagacaaaaaggggaaggagaacacagaaatcctagggacacaaattcagggtgaggaaaacaaagcaagggctgggcacagtggctcacacgtgtaatctcagcactttgggaggccgaggcaggtggatcacctgatgtcaggagttcaagaccagcct

SEQ ID NO: 148532 - DNA, 997 bp, Homo sapiens; identical to SEQ ID NO: 148531
  Payload ID: 9413
  Gene Symbol: LILRA5
  Gene Name: leukocyte immunoglobulin-like receptor, subfamily A (with TM domain), member 5
  Uniprot ID: A6NI73
  ENST ID: ENST00000612266
  CDS Start-End: 73-834

SEQ ID NO: 148533 - DNA, 1365 bp, Homo sapiens; identical to SEQ ID NO: 148529
  Payload ID: 9413
  Gene Symbol: LILRA5
  Gene Name: leukocyte immunoglobulin-like receptor, subfamily A (with TM domain), member 5
  Uniprot ID: A6NI73
  ENST ID: ENST00000620091
  CDS Start-End: 121-1020

SEQ ID NO: 148534 - DNA, 1080 bp, Homo sapiens
  Payload ID: 9413
  Gene Symbol: LILRA5
  Gene Name: leukocyte immunoglobulin-like receptor, subfamily A (with TM domain), member 5
  Uniprot ID: A6NI73
  ENST ID: ENST00000611164
  CDS Start-End: 56-919
tggcatggacctgcatcttccctgaagcatctccagggctgaaaaatcactgaccatggcaccatggtctcatccatctgcacagctgcagccagtgggaggagacgccgtgagccctgccctcatggttctgctctgcctcgggaacctctccaaagccaccctctgggctgagccaggctctgtgatcagccgggggaactctgtgaccatccggtgtcaggggaccctggaggcccaggaataccgtctggttaaagagggaagcccagaaccctgggacacacagaacccactggagcccaagaacaaggccagattctccatcccatccatgacagagcaccatgcagggagataccgctgttactactacagccctgcaggctggtcagagcccagcgaccccctggagctggtggtgacaggattctacaacaaacccaccctctcagccctgcccagtcctgtggtgacctcaggagagaacgtgaccctccagtgtggctcacggctgagattcgacaggttcattctgactgaggaaggagaccacaagctctcctggaccttggactcacagctgacccccagtgggcagttccaggccctgttccctgtgggccctgtgacccccagccacaggtggatgctcagatgctatggctctcgcaggcatatcctgcaggtatggtcagaacccagtgacctcctggagattccggtctcaggagcagctgataacctcagtccgtcacaaaacaagtctgactctgggactgcctcacaccttcaggattacgcagtagagaatctcatccgcatgggcatggccggcttgatcctggtggtccttgggattctgatatttcaggattggcacagccagagaagcccccaagctgcagctggaaggtgaacagaagagagaacaatgcaccattgaatgctggagccttggaagcgaatctgatggtcctaggaggttcgggaagaccatctgaggcctatgccatctggactgtctgctggcaatttctttttttctttcttttcttttctttcttttttttttttttt

SEQ ID NO: 148535 - DNA, 1363 bp, Homo sapiens; identical to SEQ ID NO: 148527
  Payload ID: 9413
  Gene Symbol: LILRA5
  Gene Name: leukocyte immunoglobulin-like receptor, subfamily A (with TM domain), member 5
  Uniprot ID: A6NI73
  ENST ID: ENST00000621042
  CDS Start-End: 121-1020

SEQ ID NO: 148536 - DNA, 922 bp, Homo sapiens; identical to SEQ ID NO: 148528
  Payload ID: 9413
  Gene Symbol: LILRA5
  Gene Name: leukocyte immunoglobulin-like receptor, subfamily A (with TM domain), member 5
  Uniprot ID: A6NI73
  ENST ID: ENST00000620692
  CDS Start-End: 80-877

SEQ ID NO: 148537 - DNA, 1080 bp, Homo sapiens; identical to SEQ ID NO: 148534
  Payload ID: 9413
  Gene Symbol: LILRA5
  Gene Name: leukocyte immunoglobulin-like receptor, subfamily A (with TM domain), member 5
  Uniprot ID: A6NI73
  ENST ID: ENST00000614299
  CDS Start-End: 56-919

SEQ ID NO: 148538 - DNA, 997 bp, Homo sapiens; identical to SEQ ID NO: 148531
  Payload ID: 9413
  Gene Symbol: LILRA5
  Gene Name: leukocyte immunoglobulin-like receptor, subfamily A (with TM domain), member 5
  Uniprot ID: A6NI73
  ENST ID: ENST00000616133
  CDS Start-End: 73-834

SEQ ID NO: 148539 - DNA, 1078 bp, Homo sapiens; identical to SEQ ID NO: 148530
  Payload ID: 9413
  Gene Symbol: LILRA5
  Gene Name: leukocyte immunoglobulin-like receptor, subfamily A (with TM domain), member 5
  Uniprot ID: A6NI73
  ENST ID: ENST00000486742
  CDS Start-End: 56-919

SEQ ID NO: 148540 - DNA, 922 bp, Homo sapiens; identical to SEQ ID NO: 148528
  Payload ID: 9413
  Gene Symbol: LILRA5
  Gene Name: leukocyte immunoglobulin-like receptor, subfamily A (with TM domain), member 5
  Uniprot ID: A6NI73
  ENST ID: ENST00000613559
  CDS Start-End: 80-877

SEQ ID NO: 148541 - DNA, 1363 bp, Homo sapiens; identical to SEQ ID NO: 148527
  Payload ID: 9413
  Gene Symbol: LILRA5
  Gene Name: leukocyte immunoglobulin-like receptor, subfamily A (with TM domain), member 5
  Uniprot ID: A6NI73
  ENST ID: ENST00000612621
  CDS Start-End: 121-1020

SEQ ID NO: 148542 - DNA, 1080 bp, Homo sapiens; identical to SEQ ID NO: 148534
  Payload ID: 9413
  Gene Symbol: LILRA5
  Gene Name: leukocyte immunoglobulin-like receptor, subfamily A (with TM domain), member 5
  Uniprot ID: A6NI73
  ENST ID: ENST00000620898
  CDS Start-End: 56-919

SEQ ID NO: 148543 - DNA, 1395 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000245621
  CDS Start-End: 1-1395
atgacccccaccctcgcagccctgctctgcctagggctgagtctgggccccaggacccacgtgcaggcagggcccttccccaaacccaccctctgggctgagccaggctctgtgatcagctgggggagccccgtgaccatctggtgtcaggggagcctggaggcccaggagtaccgactggataaagagggaagcccagagccctgggacagaaataacccactggaacccaagaacaaggccagattctccatcccatccataacagagcaccatgcggggagataccgctgccactattacagctctgcaggctggtcagagcccagcgaccccctggagctggtgatgacaggagcctatagcaaacccaccctctcagccctgcccagccctgtggtggcctcaggggggaatatgaccctccaatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcagcctcacacgccaaggattacacagtggagaatctcatccgcatgggcatggcaggcttggtcctggtgttcctcgggattctgttatttgaggctcagcacagccagagaaacccccaagatgcagccgggaggtga

SEQ ID NO: 148544 - DNA, 1890 bp, Homo sapiens
  Payload ID: 9414
  Gene Symbol: LILRA6
  Gene Name: leukocyte immunoglobulin-like receptor, subfamily A (with TM domain), member 6
  Uniprot ID: Q6PI73
  ENST ID: ENST00000396365
  CDS Start-End: 41-1486
catccctctgcagagcccggggtcaccaggaggagacgccatgacccccaccctcgcagccctgctctgcctagggctgagtctgggccccaggacccacgtgcaggcagggcccttccccaaacccaccctctgggctgagccaggctctgtgatcagctgggggagccccgtgaccatctggtgtcaggggagcctggaggcccaggagtaccgactggataaagagggaagcccagagccctgggacagaaataacccactggaacccaagaacaaggccagattctccatcccatccataacagagcaccatgcggggagataccgctgccactattacagctctgcaggctggtcagagcccagcgaccccctggagctggtgatgacaggagcctatagcaaacccaccctctcagccctgcccagccctgtggtggcctcaggggggaatatgaccctccaatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctgcctcacacgccaaggattacacagtggagaatctcatccgcatgggcatggcaggcttggtcctggtgttcctcgggattctgttatttgaggctcagcacagccagagaaacccccaagatgcagccgggaggtgaacagcggagaggacaatgcacccttcagcgtggtggagcctcagggacagatctgatgatcccagaaggctctggaggacaatctaggacctccagaggggggtgagatttcaggccacacactgtggaaggtaatcatgtctgatcacaaattttgggtctccaccttacttccaatctatgttgtgaatgcccagttgagacccacggaaaagagctcatgggtgagtgtgaagtgcttctctgtcttaagttcccagagatccttgcctcttggaggccagcaaacactaactcttgaggaattcatgacaatatcatctgattcctccttcccagcttgtatggcagtctcccaccctcatgtgttcaatctgatgatcccaggaggttctggaacaaaa

SEQ ID NO: 148545 - DNA, 2238 bp, Homo sapiens
  Payload ID: 9414
  Gene Symbol: LILRA6
  Gene Name: leukocyte immunoglobulin-like receptor, subfamily A (with TM domain), member 6
  Uniprot ID: Q6PI73
  ENST ID: ENST00000430421
  CDS Start-End: 18-599
caccaggaggagacgccatgacccccaccctcgcagccctgctctgcctagggctgagtctgggccccaggacccacgtgcaggcagggcccttccccaaacccaccctctgggctgagccaggctctgtgatcagctgggggagccccgtgaccatctggtgtcaggggagcctggaggcccaggagtaccgactggataaagagggaagcccagagccctgggacagaaataacccactggaacccaagaacaaggccagattctccatcccatccataacagagcaccatgcggggagataccgctgccactattacagctctgcaggctggtcagagcccagcgaccccctggagctggtgatgacaggagcctatagcaaacccaccctctcagccctgcccagccctgtggtggcctcaggggggaatatgaccctccaatgtggctcacagaagggatatcaccattttgttctgatgaaggaaggagaacaccagctcccccggaccctggactcacagcagctccacagtggggggttccaggccctgttccctgtgggccccgtgaaccccagccacaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctgcctcacacgccaaggattacacagtggagaatctcatccgcatgggcatggcaggcttggtcctggtgttcctcgggattctgttatttgaggctcagcacagccagagaaacccccaagatgcagccgggaggtgaacagcggagaggacaatgcacccttcagcgtggtggagcctcagggacagatctgatgatcccagaaggctctggaggacaatctaggacctccagaggggggtgagatttcaggccacacactgtggaagcttgtatggcagtctcccaccctcatgtgttcaatctgatgatcccaggaggttctggaacaaaatctacagcctatgctttctggactatctgtcgatcattcctgaagagagggatcaatgttgagacggggtttcaccatgttgctctggctggtctcgaactcctgacctaaggtgatccaccagcgtcggctttccatagtgctgggattacaggtgtgagccactatgcctggccaacttttataatttctgtgctgggaacattccaaatcttcatttctcactcatgtggaaaatacaataatctgttgctaactatggtcaccctactgagctctcaggccctggaacttactccttctctccacctgtatttctgcacccgtccaccaacctctctccatccctgtcctccacactcccttgccagcctctgttgacaaccattctactctctgccatcacaaggcccacttttgtagcttccgcgtgagtgagaacatgctcctctttctgggcctggcttatttcactgaacataatgtcttccagattcatctgtgttgctgaacatggtacaatttccttctttttatgcctgaatattatttcattgtgtatatagaccacatgttccttatccattcatccattgatggacataggttgattccatatcttggctattgtgaatactgctgcaataaacatggcaatgcagaca

SEQ ID NO: 148546 - DNA, 1217 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000622510
  CDS Start-End: 45-1193
ggctcatccctctgcagagcgcggggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccaggtgtggtcccaccccagtgaccccctggagattctgccctcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctcaccccagtgagcccctggaactcatggtctcaggacactctggaggctccagcctcccacccacagggccgccctccacacctgcctcacacgccaaggattacacagtggagaatctcatccgcatgggcatggcaggcttggtcctggtgttcctcgggattctgttatttgaggctcagcacagccagagaaacccccaagatgcagccgggaggtgaacagcggagaggacaatgcaccct

SEQ ID NO: 148547 - DNA, 2238 bp, Homo sapiens
  Payload ID: 9414
  Gene Symbol: LILRA6
  Gene Name: leukocyte immunoglobulin-like receptor, subfamily A (with TM domain), member 6
  Uniprot ID: Q6PI73
  ENST ID: ENST00000613333
  CDS Start-End: 18-599
caccggaaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctgcctcacacgccaaggattacacagtggagaatctcatccgcatgggcatggcaggcttggtcctggtgttcctcgggattctgttatttgaggctcagcacagccagagaaacccccaagatgcagccgggaggtgaacagcggagaggacaatgcacccttcagcgtggtggagcctcagggacagatctgatgatcccagaaggctctggaggacaatctaggacctccagaggggggtgagatttcaggccacacactgtggaagcttgtatggcagtctcccaccctcatgtgttcaatctgatgatcccaggaggttctggaacaaaatctacagcctatgctttctggactatctgtcgatcattcctgaagagagggatcaatgttgagacggggtttcaccatgttgctctggctggtctcgaactcctgacctaaggtgatccaccagcgtcggctttccatagtgctgggattacaggtgtgagccactatgcctggccaacttttataatttctgtgctgggaacattccaaatcttcatttctcactcatgtggaaaatacaataatctgttgctaactatggtcaccctactgagctctcaggccctggaacttactccttctctccacctgtatttctgcacccgtccaccaacctctctccatccctgtcctccacactcccttgccagcctctgttgacaaccattctactctctgccatcacaaggcccacttttgtagcttccgcgtgagtgagaacatgctcctctttctgggcctggcttatttcactgaacataatgtcttccagattcatctgtgttgctgaacatggtacaatttccttctttttatgcctgaatattatttcattgtgtatatagaccacatgttccttatccattcatccattgatggacataggttgattccatatcttggctattgtgaatactgctgcaataaacatggcaatgcagaca

SEQ ID NO: 148548 - DNA, 1924 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000622891
  CDS Start-End: 3-584
ccatgacccccaccctcgcagccctgctctgcctagggctgagtctgggccccaggacccacgtgcaggcagggcccttccccaaacccaccctctgggctgagccaggctctgtgatcagctgggggagccccgtgaccatctggtgtcaggggagcctggaggcccaggagtaccgactggataaagagggaagcccagagccctgggacagaaataacccactggaacccaagaacaaggccagattctccatcccatccataacagagcaccatgcggggagataccgctgccactattacagctctgcaggctggtcagagcccagcgaccccctggagctggtgatgacaggagcctatagcaaacccaccctctcagccctgcccagccctgtggtggcctcaggggggaatatgaccctccaatgtggctcacagaagggatatcaccattttgttctgatgaaggaaggagaacaccagctcccccggaccctggactcacagcagctccacagtggggggttccaggccctgttccctgtgggccccgtgaaccccagccacaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148549 - DNA, 2825 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000611687
  CDS Start-End: 112-2010
atgacaagaaggacccagcctccgagcggccacaccctgtgtgtctctctgtcctgccagcactgagggctcatccctctgcagagcgcggggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccaggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctcaccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaaaacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaatattatacatcgaacttatgacatgggaaaattaagaagcataaataggccgggcgcggtggctcacgcctataatctcagcactttgggaggctgatgcgggcggatcatgaggtcaggagatcgagaccatcctggctaacacggtgaaaccccgtctctactaaaaatacaaaaaaattagccgggcgtggtggcgagtgcctatagtcccagctactcaggaggctgaggcaggagaatggcatgagcccgggaggcagagcttgcagtgagctgagatcgcaccactgcactccagcctgggcgacagagtgagattccgtctcgaaaaaaaaaaaaaaagaaagaaaaaaaataaaaaagaagcataaccagg

SEQ ID NO: 148550 - DNA, 1636 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000621072
  CDS Start-End: 18-599
caccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctcaccccagtgagcccctggagctcatggtctcaggaccctctggaggctccagcctcccacccacagggccgccctccacacctgcctcacacgccaaggattacacagtggagaatctcatccgcatgggcatggcaggcttggtcctggtgttcctcgggattctgttatttgaggctcagcacagccagagaaacccccaagatgcagccgggaggtgaacagcggagaggacaatgcacccttcagcgtggtggagcctcagggacagatctgatgatcccagaaggctctggaggacaatctaggacctccagaggggggtgagatttcaggccacacactgtggaagcttgtatggcagtctcccaccctcatgtgttcaatctgatgatcccaggaggttctggaacaaaatctacagcctatgctttctggactatctgtcgatcattcctgaagagagggatcaatgttgag

SEQ ID NO: 148551 - DNA, 1247 bp, Homo sapiens
  Payload ID: 9414
  Gene Symbol: LILRA6
  Gene Name: leukocyte immunoglobulin-like receptor, subfamily A (with TM domain), member 6
  Uniprot ID: Q6PI73
  ENST ID: ENST00000616720
  CDS Start-End: 3-584
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtgagtcactgaggcctcgtgg

SEQ ID NO: 148552 - DNA, 1653 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000621815
  CDS Start-End: 32-1570
gcagagcgcggggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccaggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctcaccccagtgagcccctggaactcatggtctcaggacactctggaggctccagcctcccacccacagggccgccctccacacctggtgagtcactgaggcctcttggggagcgcggcctcccccagggcagtctgagtctcccaaaggatcccactcccctcccctcaaggacgggcttgtgtcccaggggctctgaggctgggctggtgaagagtggggggcaaggcagagagagatgttggggcccagccaggaggaggagccgggctgatgtggggagcaaggtagccccaggcttcacctccctgtcctgacccaggaggtcctgaggaccagccccttaaccccccagggtcaggccctcagaatggtgagtgaggggctctgagtgggagat

SEQ ID NO: 148553 - DNA, 1924 bp, Homo sapiens
  Payload ID: 9414
  Gene Symbol: LILRA6
  Gene Name: leukocyte immunoglobulin-like receptor, subfamily A (with TM domain), member 6
  Uniprot ID: Q6PI73
  ENST ID: ENST00000616252
  CDS Start-End: 3-584
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctcaccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148554 - DNA, 1619 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000620938
  CDS Start-End: 32-1546
gcagagcgcggggtcaccggaaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtgagtcactgaggcctcgtggggagcgcggcctcccccagggcagtctgagtctcccaaaggatcccactcccctcccctcaaggacgggcttgtgtcccaggggctctgaggctgggctggtgaagagtggggggttcaaggcagagagagatgttggggcccagccaggaggaggagccgggctgatgtggggagcaaggtagccccaggcttcacctccctgtcctgacccaggaggtcctgaggaccagcccctcaaccccccagggtcaggcc

SEQ ID NO: 148555 - DNA, 2825 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000617251
  CDS Start-End: 112-2010
atgacaagaaggacccagcctccgagcggccacaccctgtgtgtctctctgtcctgccagcactgagggctcatccctctgcagagcgcggggtcaccggaaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaaaacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaatattatacatcgaacttatgacatgggaaaattaagaagcataaataggccgggcgcggtggctcacgcctataatctcagcactttgggaggctgatgcgggcggatcatgaggtcaggagatcgagaccatcctggctaacacggtgaaaccccgtctctactaaaaatacaaaaaaattagccgggcgtggtggcgagtgcctatagtcccagctactcaggaggctgaggcaggagaatggcatgagcccgggaggcagagcttgcagtgagctgagatcgcaccactgcactccagcctgggcgacagagtgagattccgtctcgaaaaaaaaaaaaaaagaaagaaaaaaaataaaaaagaagcataaccagg

SEQ ID NO: 148556 - DNA, 1217 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000613255
  CDS Start-End: 45-1193
ggctcatccctctgcagagcgccgggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccctgggtgtggtcccaccccagtgaccccctggagattctgccctcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctcaccccagtgagcccctggagctcatggtctcaggaccctctggaggctccagcctcccacccacagggccgccctccacacctgcctcacacgccaaggattacacagtggagaatctcatccgcatgggcatggcaggcttggtcctggtgttcctcgggattctgttatttgaggctcagcacagccagagaaacccccaagatgcagccgggaggtgaacagcggagaggacaatgcaccct

SEQ ID NO: 148557 - DNA, 1890 bp, Homo sapiens
  Payload ID: 9414
  Gene Symbol: LILRA6
  Gene Name: leukocyte immunoglobulin-like receptor, subfamily A (with TM domain), member 6
  Uniprot ID: Q6PI73
  ENST ID: ENST00000621570
  CDS Start-End: 41-1486
catccctctgcagagcgcggggtcaccggaaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctgcctcacacgccaaggattacacagtggagaatctcatccgcatgggcatggcaggcttggtcctggtgttcctcgggattctgttatttgaggctcagcacagccagagaaacccccaagatgcagccgggaggtgaacagcggagaggacaatgcacccttcagcgtggtggagcctcagggacagatctgatgatcccagaaggctctggaggacaatctaggacctccagaggggggtgagatttcaggccacacactgtggaaggtaatcatgtctgatcacaaattttgggtctccaccttacttccaatctatgttgtgaatgcccagttgagacccacggaaaagagctcatgggtgagtgtgaagtgcttctctgtcttaagttcccagagatccttgcctcttggaggccagcaaacactaactcttgaggaattcatgacaatatcatctgattcctccttcccagcttgtatggcagtctcccaccctcatgtgttcaatctgatgatcccaggaggttctggaacaaaa

SEQ ID NO: 148558 - DNA, 1260 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000620837
  CDS Start-End: 112-1260
atgacaagaaggacccagcctccgagcggccacaccctgtgtgtctctctgtcctgccagcactgagggctcatccctctgcagagcgcggggtcaccggaaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccgggtgtggtcccaccccagtgaccccctggagattctgccctcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctgcctcacacgccaaggattacacagtggagaatctcatccgcatgggcatggcaggcttggtcctggtgttcctcgggattctgttatttgaggctcagcacagccagagaaacccccaagatgcagccgggaggtga

SEQ ID NO: 148559 - DNA, 1557 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000618982
  CDS Start-End: 112-1557
atgacaagaaggacccagcctccgagcggccacaccctgtgtgtctctctgtcctgccagcactgagggctcatccctctgcagagcgcggggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccaggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctcaccccagtgagcccctggaactcatggtctcaggacactctggaggctccagcctcccacccacagggccgccctccacacctgcctcacacgccaaggattacacagtggagaatctcatccgcatgggcatggcaggcttggtcctggtgttcctcgggattctgttatttgaggctcagcacagccagagaaacccccaagatgcagccgggaggtga

SEQ ID NO: 148560 - DNA, 2114 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000616329
  CDS Start-End: 3-1949
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctcaccccagtgagcccctggagctcatggtctcaggacactctggaggctccagcctcccacccacagggccgccctccacacctggaggtcctgaggaccagccccttaaccccccagggtcaggccctcagaatggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgctgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148561 - DNA, 1446 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000621450
  CDS Start-End: 1-1446
atgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctcaccccagtgagcccctggagctcatggtctcaggaccctctggaggctccagcctcccacccacagggccgccctccacacctgcctcacacgccaaggattacacagtggagaatctcatccgcatgggcatggcaggcttggtcctggtgttcctcgggattctgttatttgaggctcagcacagccagagaaacccccaagatgcagccgggaggtga

SEQ ID NO: 148562 - DNA, 1655 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000621199
  CDS Start-End: 32-1546
gcagagcgccgggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctcaccccagtgagcccctggagctcatggtctcaggaccctctggaggctccagcctcccacccacagggccgccctccacacctggtgagtcactgaggcctcgtggggagcgcggcctcccccagggcagtctgagtctcccaaaggatcccactcccctcccctcaaggacgggcttgtgtcccaggggctctgaggctgggctggtgaagagtggggggttcaaggcagagagagatgttggggcccagccaggaggaggagccgggctgatgtggggagcaaggtagccccaggcttcacctccctgtcctgacccaggaggtcctgaggaccagccccttaaccccccagggtcaggccctcagaatggtgagtgaggggctctgagtgggagat

SEQ ID NO: 148563 - DNA, 1655 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000618491
  CDS Start-End: 32-1546
gcagagcgcggggtcaccggaaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtgagtcactgaggcctcgtggggagcgcggcctcccccagggcagtctgagtctcccaaaggatcccactcccctcccctcaaggacgggcttgtgtcccaggggctctgaggctgggctggtgaagagtggggggttcaaggcagagagagatgttggggcccagccaggaggaggagccgggctgatgtggggagcaaggtagccccaggcttcacctccctgtcctgacccaggaggtcctgaggaccagccccttaaccccccagggtcaggccctcagaatcgtgagtgaggggctctgagtgggagat

SEQ ID NO: 148564 - DNA, 1655 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000616282
  CDS Start-End: 32-1546
gcagagcccggggtcaccaggaggagacgccatgacccccaccctcgcagccctgctctgcctagggctgagtctgggccccaggacccacgtgcaggcagggcccttccccaaacccaccctctgggctgagccaggctctgtgatcagctgggggagccccgtgaccatctggtgtcaggggagcctggaggcccaggagtaccgactggataaagagggaagcccagagccctgggacagaaataacccactggaacccaagaacaaggccagattctccatcccatccataacagagcaccatgcggggagataccgctgccactattacagctctgcaggctggtcagagcccagcgaccccctggagctggtgatgacaggagcctatagcaaacccaccctctcagccctgcccagccctgtggtggcctcaggggggaatatgaccctccaatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtgagtcactgaggcctcgtggggagcgcggcctcccccagggcagtctgagtctcccaaaggatcccactcccctcccctcaaggacgggcttgtgtcccaggggctctgaggctgggctggtgaagagtggggggttcaaggcagagagagatgttggggcccagccaggaggaggagccgggctgatgtggggagcaaggtagccccaggcttcacctccctgtcctgacccaggaggtcctgaggaccagccccttaaccccccagggtcaggccctcagaatcgtgagtgaggggctctgagtgggagat

SEQ ID NO: 148565 - DNA, 1508 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000615203
  CDS Start-End: 18-599
caccaggaggagacgccatgacccccaccctcgcagccctgctctgcctagggctgagtctgggccccaggacccacgtgcaggcagggcccttccccaaacccaccctctgggctgagccaggctctgtgatcagctgggggagccccgtgaccatctggtgtcaggggagcctggaggcccaggagtaccgactggataaagagggaagcccagagccctgggacagaaataacccactggaacccaagaacaaggccagattctccatcccatccataacagagcaccatgcggggagataccgctgccactattacagctctgcaggctggtcagagcccagcgaccccctggagctggtgatgacaggagcctatagcaaacccaccctctcagccctgcccagccctgtggtggcctcaggggggaatatgaccctccaatgtggctcacagaagggatatcaccattttgttctgatgaaggaaggagaacaccagctcccccggaccctggactcacagcagctccacagtggggggttccaggccctgttccctgtgggccccgtgaaccccagccacaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctgcctcacacgccaaggattacacagtggagaatctcatccgcatgggcatggcaggcttggtcctgctgttcctcgggattctgttatttgaggctcagcacagccagagaaacccccaagatgcagccgggaggtgaacagcggagaggacaatgcacccttcagcgtggtggagcctcagggacagatctgatgatcccagaaggctctggaggacaatctaggacgtccagaggggggtgagatttcaggccacacactgtggaag

SEQ ID NO: 148566 - DNA, 1653 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000620914
  CDS Start-End: 32-1570
gcagagcgcggggtcaccggaaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtgagtcactgaggcctcgtggggagcgccgcctcccccagggcagtctgagtctcccaaaggatcccactcccctcccctcaaggacgggcttgtgtcccaggggctctgaggctgggctggtgaagagtgggggtcgaggcagagggagatgttggggcccagccaggaggaggagccgggctgatgtggggggcaagacagccccagccttcacctccctgtcctgacccaggaggtcctgaggaccagccccttaaccccccagggtcaggccctcagaatcgtgagtgaggggctctgagtgggagat

SEQ ID NO: 148567 - DNA, 1924 bp, Homo sapiens
  Payload ID: 9414
  Gene Symbol: LILRA6
  Gene Name: leukocyte immunoglobulin-like receptor, subfamily A (with TM domain), member 6
  Uniprot ID: Q6PI73
  ENST ID: ENST00000616466
  CDS Start-End: 3-584
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148568 - DNA, 1416 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000613668
  CDS Start-End: 3-578
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacagctgacaggttgtggggagtttggctggtgactgaatctggaaaggacccagagtgatgtgttgaaggacgggctgaaggcatgagggagaccccatggggaggctctgacatgggaggaggagcccttgaccacgttcacctggaaggggaggactcaggaaggcatcggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtgagtcactgaggcctcgtgg

SEQ ID NO: 148569 - DNA, 2114 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000614123
  CDS Start-End: 3-1949
ccatgacccccaccctcgcagccctgctctgcctagggctgagtctgggccccaggacccacgtgcaggcagggcccttccccaaacccaccctctgggctgagccaggctctgtgatcagctgggggagccccgtgaccatctggtgtcaggggagcctggaggcccaggagtaccgactggataaagagggaagcccagagccctgggacagaaataacccactggaacccaagaacaaggccagattctccatcccatccataacagagcaccatgcggggagataccgctgccactattacagctctgcaggctggtcagagcccagcgaccccctggagctggtgatgacaggagcctatagcaaacccaccctctcagccctgcccagccctgtggtggcctcaggggggaatatgaccctccaatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggacactctggaggctccagcctcccacccacagggccgccctccacacctggaggtcctgaggaccagccccttaaccccccagggtcaggccctcagaatcgtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148570 - DNA, 2066 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000612434
  CDS Start-End: 3-1901
ccatgacccccaccctcgcagccctgctctgcctagggctgagtctgggccccaggacccacgtgcaggcagggcccttccccaaacccaccctctgggctgagccaggctctgtgatcagctgggggagccccgtgaccatctggtgtcaggggagcctggaggcccaggagtaccgactggataaagagggaagcccagagccctgggacagaaataacccactggaacccaagaacaaggccagattctccatcccatccataacagagcaccatgcggggagataccgctgccactattacagctctgcaggctggtcagagcccagcgaccccctggagctggtgatgacaggagcctatagcaaacccaccctctcagccctgcccagccctgtggtggcctcaggggggaatatgaccctccaatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148571 - DNA, 1217 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000611358
  CDS Start-End: 45-1193
ggctcatccctctgcagagcccggggtcaccaggaggagacgccatgacccccaccctcgcagccctgctctgcctagggctgagtctgggccccaggacccacgtgcaggcagggcccttccccaaacccaccctctgggctgagccaggctctgtgatcagctgggggagccccgtgaccatctggtgtcaggggagcctggaggcccaggagtaccgactggataaagagggaagcccagagccctgggacagaaataacccactggaacccaagaacaaggccagattctccatcccatccataacagagcaccatgcggggagataccgctgccactattacagctctgcaggctggtcagagcccagcgaccccctggagctggtgatgacaggagcctatagcaaacccaccctctcagccctgcccagccctgtggtggcctcaggggggaatatgaccctccaatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccgggtgtggtcccaccccagtgaccccctggagattctgccctcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctgcctcacacgccaaggattacacagtggagaatctcatccgcatgggcatggcaggcttggtcctgctgttcctcgggattctgttatttgaggctcagcacagccagagaaacccccaagatgcagccgggaggtgaacagcggagaggacaatgcaccct

SEQ ID NO: 148572 - DNA, 1557 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000620480
  CDS Start-End: 112-1557
atgacaagaaggacccagcctccgagcggccacaccctgtgtgtctctctgtcctgccagcactgagggctcatccctctgcagagcccggggtcaccaggaggagacgccatgacccccaccctcgcagccctgctctgcctagggctgagtctgggccccaggacccacgtgcaggcagggcccttccccaaacccaccctctgggctgagccaggctctgtgatcagctgggggagccccgtgaccatctggtgtcaggggagcctggaggcccaggagtaccgactggataaagagggaagcccagagccctgggacagaaataacccactggaacccaagaacaaggccagattctccatcccatccataacagagcaccatgcggggagataccgctgccactattacagctctgcaggctggtcagagcccagcgaccccctggagctggtgatgacaggagcctatagcaaacccaccctctcagccctgcccagccctgtggtggcctcaggggggaatatgaccctccaatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctgcctcacacgccaaggattacacagtggagaatctcatccgcatgggcatggcaggcttggtcctgctgttcctcgggattctgttatttgaggctcagcacagccagagaaacccccaagatgcagccgggaggtga

SEQ ID NO: 148573 - DNA, 1636 bp, Homo sapiens
  Payload ID: 9414
  Gene Symbol: LILRA6
  Gene Name: leukocyte immunoglobulin-like receptor, subfamily A (with TM domain), member 6
  Uniprot ID: Q6PI73
  ENST ID: ENST00000614434
  CDS Start-End: 18-599
caccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacggggttattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctcaccccagtgagcccctggaactcatggtctcaggacactctggaggctccagcctcccacccacagggccgccctccacacctgcctcacacgccaaggattacacagtggagaatctcatccgcatgggcatggcaggcttggtcctggtgttcctcgggattctgttatttgaggctcagcacagccagagaaacccccaagatgcagccgggaggtgaacagcggagaggacaatgcacccttcagcgtggtggagcctcagggacagatctgatgatcccagaaggctctggaggacaatctaggacctccagaggggggtgagatttcaggccacacactgtggaagcttgtatggcagtctcccaccctcatgtgttcaatctgatgatcccaggaggttctggaacaaaatctacagcctatgctttctggactatctgtcgatcattcctgaagagagggatcaatgttgag

SEQ ID NO: 148574 - DNA, 1653 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000612257
  CDS Start-End: 32-1570
gcagagcccggggtcaccaggaggagacgccatgacccccaccctcgcagccctgctctgcctagggctgagtctgggccccaggacccacgtgcaggcagggcccttccccaaacccaccctctgggctgagccaggctctgtgatcagctgggggagccccgtgaccatctggtgtcaggggagcctggaggcccaggagtaccgactggataaagagggaagcccagagccctgggacagaaataacccactggaacccaagaacaaggccagattctccatcccatccataacagagcaccatgcggggagataccgctgccactattacagctctgcaggctggtcagagcccagcgaccccctggagctggtgatgacaggagcctatagcaaacccaccctctcagccctgcccagccctgtggtggcctcaggggggaatatgaccctccaatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtgagtcactgaggcctcgtggggagcgccgcctcccccagggcagtctgagtctcccaaaggatcccactcccctcccctcaaggacgggcttgtgtcccaggggctctgaggctgggctggtgaagagtgggggtcgaggcagagggagatgttggggcccagccaggaggaggagccgggctgatgtggggggcaagacagccccagccttcacctccctgtcctgacccaggaggtcctgaggaccagccccttaaccccccagggtcaggccctcagaatcgtgagtgaggggctctgagtgggagat

SEQ ID NO: 148575 - DNA, 2825 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000618663
  CDS Start-End: 112-2010
atgacaagaaggacccagcctccgagcggccacaccctgtgtgtctctctgtcctgccagcactgagggctcatccctctgcagagcccggggtcaccaggaggagacgccatgacccccaccctcgcagccctgctctgcctagggctgagtctgggccccaggacccacgtgcaggcagggcccttccccaaacccaccctctgggctgagccaggctctgtgatcagctgggggagccccgtgaccatctggtgtcaggggagcctggaggcccaggagtaccgactggataaagagggaagcccagagccctgggacagaaataacccactggaacccaagaacaaggccagattctccatcccatccataacagagcaccatgcggggagataccgctgccactattacagctctgcaggctggtcagagcccagcgaccccctggagctggtgatgacaggagcctatagcaaacccaccctctcagccctgcccagccctgtggtggcctcaggggggaatatgaccctccaatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaaaacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaatattatacatcgaacttatgacatgggaaaattaagaagcataaataggccgggcgcggtggctcacgcctataatctcagcactttgggaggctgatgcgggcggatcatgaggtcaggagatcgagaccatcctggctaacacggtgaaaccccgtctctactaaaaatacaaaaaaattagccgggcgtggtggcgagtgcctatagtcccagctactcaggaggctgaggcaggagaatggcatgagcccgggaggcagagcttgcagtgagctgagatcgcaccactgcactccagcctgggcgacagagtgagattccgtctcgaaaaaaaaaaaaaaagaaagaaaaaaaataaaaaagaagcataaccagg

SEQ ID NO: 148576 - DNA, 1443 bp, Homo sapiens
  Payload ID: 9414
  Gene Symbol: LILRA6
  Gene Name: leukocyte immunoglobulin-like receptor, subfamily A (with TM domain), member 6
  ENST ID: ENST00000618682
  CDS Start-End: 1-1443
atgacccccaccctcgcagccctgctctgcctagggctgagtctgggccccaggacccacgtgcaggcagggcccttccccaaacccaccctctgggctgagccaggctctgtgatcagctgggggagccccgtgaccatctggtgtcaggggagcctggaggcccaggagtaccgactggataaagagggaagcccagagccctgggacagaaataacccactggaacccaagaacaaggccagattctccatcccatccataacagagcaccatgcggggagataccgctgccactattacagctctgcaggctggtcagagcccagcgaccccctggagctggtgatgacaggagcctatagcaaacccaccctctcagccctgcccagccctgtggtggcctcaggggggaatatgaccctccaatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcagggacactctggaggctccagcctcccacccacagggccgccctccacaccccagcctcacacgccaaggattacacagtggagaatctcatccgcatgggcatggcaggcttggtcctgctgttcctcgggattctgttatttgaggctcagcacagccagagaaacccccaagatgcagccggg

SEQ ID NO: 148577 - DNA, 1317 bp, Homo sapiens
  Payload ID: 9415
  Gene Symbol: LILRA3
  Gene Name: leukocyte immunoglobulin-like receptor, subfamily A (without TM domain), member 3
  ENST ID: ENST00000617541
  CDS Start-End: 1-1128
atgacccccatcctcacggtcctgatctgtctcgggctgagcctggaccccaggacccacgtgcaggcagggcccctccccaagcccaccctctgggctgagccaggctctgtgatcacccaagggagtcctgtgaccctcaggtgtcaggggagcctggagacgcaggagtaccatctatatagagaaaagaaaacagcactctggattacacggatcccacaggagcttgtgaagaagggccagttccccatcctatccatcacctgggaacatgcagggcggtattgctgtatctatggcagccacactgcaggcctctcagagagcagtgaccccctggagctggtggtgacaggagcctacagcaaacccaccctctcagctctgcccagccctgtggtgacctcaggagggaatgtgaccatccagtgtgactcacaggtggcatttgatggcttcattctgtgtgtttctaagaagccatcactctcagtgcagccgggtcctgtcgtggcccctggggagaagctgaccttccagtgtggctctgatgccggctacgacagatttgttctgtacaaggagtggggacgtgacttcctccagcgccctggccggcagccccaggctgggctctcccaggccaacttcaccctgggccctgtgagccgctcctacgggggccagtacacatgctccggtgcatacaacctctcctccgagtggtcggcccccagcgaccccctggacatcctgatcacaggacagatccgtgccagacccttcctctccgtgcggccgggccccacagtggcctcaggagagaacgtgaccctgctgtgtcagtcacagggagggatgcacactttccttttgaccaaggagggggcagctgattccccgctgcgtctaaaatcaaagcgccaatctcataagtaccaggctgaattccccatgagtcctgtgacctcggcccacgcggggacctacaggtgctacggctcactcagctccaacccctacctgctgactcaccccagtgaccccctggagctcgtggtctcaggagcagctgagaccctcagcccaccacaaaacaagtccgactccaaggctggtgagtgaggagatgcttgccgtgatgacgctgggcacagagggtcaggtcctgtcaagaggagctgggtgtcctgggtggacatttgaagaattatattcattccaacttgaagaattattcaacacctttaacaatgtatatgtgaagtactttattctttcatattttaaaaataaaagataattatccatgag

SEQ ID NO: 148578 - DNA, 737 bp, Homo sapiens
  Payload ID: 9415
  Gene Symbol: LILRA3
  Gene Name: leukocyte immunoglobulin-like receptor, subfamily A (without TM domain), member 3
  ENST ID: ENST00000610305
  CDS Start-End: 422-737
gcgtctctgctgacctgagtctgccctgcaccatggacctgcattttccctgaagcatctccacgacggatgagatgactggccatgggctgagtctgagcttcaggacccatgtgcaggcagctcagcctgggctgcacagccaggtgtcaggtgcgtctctgctgatctgagtccaccctgcagcatggacctgcatcttccctgaaggatctccagggctggagggacgactgccatgccctacaggaaagacagccaggctcctgggagggcagttccacttcctgtgtggctgcagatgacaaaaccccatgagaagaaggaccgagcctccaagtgtccacaccctgtgtgtcctctgtcctgccagcaccgagggctcatccatccacagagcagtgcagtgggaggagacgccatgacccccatcctcacggtcctgatctgtctcgggctgagcctggaccccaggacccacgtgcaggcagggcccctccccaagcccaccctctgggctgagccaggctctgtgatcacccaagggagtcctgtgaccctcaggtgtcaggggagcctggagacgcaggagtaccatctatatagagaaaagaaaacagcactctggattacacggatcccacaggagcttgtgaagaagggccagttccccatcctatccatcacctgggaacatgcagggcggtattgctgtatctatggcagccacactgcag

SEQ ID NO: 148579 - DNA, 737 bp, Homo sapiens; identical to SEQ ID NO: 148578
  Payload ID: 9415
  Gene Symbol: LILRA3
  Gene Name: leukocyte immunoglobulin-like receptor, subfamily A (without TM domain), member 3
  ENST ID: ENST00000613018
  CDS Start-End: 422-737

SEQ ID NO: 148580 - DNA, 1911 bp, Homo sapiens
  Payload ID: 9415
  Gene Symbol: LILRA3
  Gene Name: leukocyte immunoglobulin-like receptor, subfamily A (without TM domain), member 3
  ENST ID: ENST00000619928
  CDS Start-End: 184-1653
ctcactgccacacacagctcagcctgggctgcacagccaggtgtcaggtgcgtctctgctgatctgagtccaccctgcagcatggacctgcatcttccctgaaggatctccagggctggagggacgactgccatgcaccgagggctcatccatccacagagcagtgcagtgggaggagacgccatgacccccatcctcacggtcctgatctgtctcgggctgagcctggaccccaggacccacgtgcaggcagggcccctccccaagcccaccctctgggctgagccaggctctgtgatcacccaagggagtcctgtgaccctcaggtgtcaggggagcctggagacgcaggagtaccatctatatagagaaaagaaaacagcactctggattacacggatcccacaggagcttgtgaagaagggccagttccccatcctatccatcacctgggaacatgcagggcggtattgctgtatctatggcagccacactgcaggcctctcagagagcagtgaccccctggagctggtggtgacaggagcctacagcaaacccaccctctcagctctgcccagccctgtggtgacctcaggagggaatgtgaccatccagtgtgactcacaggtggcatttgatggcttcattctgtgtaaggaaggagaagatgaacacccacaatgcctgaactcccattcccatgcccgtgggtcatcccgggccatcttctccgtgggccccgtgagcccaagtcgcaggtggtcgtacaggtgctatggttatgactcgcgcgctccctatgtgtggtctctacccagtgatctcctggggctcctggtcccaggtgtttctaagaagccatcactctcagtgcagccgggtcctgtcgtggcccctggggagaagctgaccttccagtgtggctctgatgccggctacgacagatttgttctgtacaaggagtggggacgtgacttcctccagcgccctggccggcagccccaggctgggctctcccaggccaacttcaccctgggccctgtgagccgctcctacgggggccagtacacatgctccggtgcatacaacctctcctccgagtggtcggcccccagcgaccccctggacatcctgatcacaggacagatccgtgccagacccttcctctccgtgcggccgggccccacagtggcctcaggagagaacgtgaccctgctgtgtcagtcacagggagggatgcacactttccttttgaccaaggagggggcagctgattccccgctgcgtctaaaatcaaagcgccaatctcataagtaccaggctgaattccccatgagtcctgtgacctcggcccacgcggggacctacaggtgctacggctcactcagctccaacccctacctgctgactcaccccagtgaccccctggagctcgtggtctcaggagcagctgagaccctcagcccaccacaaaacaagtccgactccaaggctggagcagctgataccctcagcccatcacaaaacaacccaacctcacacccccaggattacacagtggagaatctcatccacatgggcaaggctggcttgatcctggtggtcctcaggattctgttatttgaggctcagcacagccagagaagcccctaagatgcagctaggaggtgaacagcagagaggacaatgcatctctcagagtggtggaaccttgggaatagatatggtgatcccaggaggttccgggagacaatttagggccaatgctatctggactgtctgctgataatttctagaaggaggaatcagtgttggattgcagagatattttgcagggtgatccatggaggaccattaacatgtgatacctttcctctctattaatgttgacttcccttggttggatcccct

SEQ ID NO: 148581 - DNA, 481 bp, Homo sapiens
  Payload ID: 9415
  Gene Symbol: LILRA3
  Gene Name: leukocyte immunoglobulin-like receptor, subfamily A (without TM domain), member 3
  ENST ID: ENST00000619618
  CDS Start-End: 369-481
gcctgatgtcagatgcgtctctgctgacctgagtctgccctgcaccatggacctgcattttccctgaagcatctccacgacggatgagatgactggccatgggctgagtctgagcttcaggacccatgtgcaggcagggattaaggtgcagagggacggccaaggatgcaatgggcaccgaggaggcaggaaagactcagagctcagcctgggctgcacagccaggtgtcaggtgcgtctctgctgatctgagtccaccctgcagcatggacctgcatcttccctgaaggatctccagggctggagggacgactgccatgcaccgagggctcatccatccacagagcagtgcagtgggaggagacgccatgacccccatcctcacggtcctgatctgtctcgggctgagcctggaccccaggacccacgtgcaggcagggcccctccccaagcccaccctctgggctgagccaggctctgt

SEQ ID NO: 148582 - DNA, 883 bp, Homo sapiens
  Payload ID: 9415
  Gene Symbol: LILRA3
  Gene Name: leukocyte immunoglobulin-like receptor, subfamily A (without TM domain), member 3
  ENST ID: ENST00000613983
  CDS Start-End: 121-883
cacagctcagcctgggctgcacagccaggtgtcaggtgcgtctctgctgatctgagtccaccctgcagcatggacctgcatcttccctgaaggatctccagggctggagggacgactgccatgcaccgagggctcatccatccacagagcagtgcagtgggaggagacgccatgacccccatcctcacggtcctgatctgtctcgggctgagcctggaccccaggacccacgtgcaggcagggcccctccccaagcccaccctctgggctgagccaggctctgtgatcacccaagggagtcctgtgaccctcaggtgtcaggggagcctggagacgcaggagtaccatctatatagagaaaagaaaacagcactctggattacacggatcccacaggagcttgtgaagaagggccagttccccatcctatccatcacctgggaacatgcagggcggtattgctgtatctatggcagccacactgcaggcctctcagagagcagtgaccccctggagctggtggtgacaggagcctacagcaaacccaccctctcagctctgcccagccctgtggtgacctcaggagggaatgtgaccatccagtgtgactcacaggtggcatttgatggcttcattctgtgtaaggaaggagaagatgaacacccacaatgcctgaactcccattcccatgcccgtgggtcatcccgggccatcttctccgtgggccccgtgagcccaagtcgcaggtggtcgtacaggtgctatggttatgactcgcgcgctccctatgtgtggtctctacccagtgatctcctggggctcctggtcccaggagcagctgagaccctcagcccaccacaaaacaagtccgactccaaggctg

SEQ ID NO: 148583 - DNA, 742 bp, Homo sapiens
  Payload ID: 9415
  Gene Symbol: LILRA3
  Gene Name: leukocyte immunoglobulin-like receptor, subfamily A (without TM domain), member 3
  ENST ID: ENST00000615584
  CDS Start-End: 427-742
cagatgcgtctctgctgacctgagtctgccctgcaccatggacctgcattttccctgaagcatctccacgacggatgagatgactggccatgggctgagtctgagcttcaggacccatgtgcaggcagctcagcctgggctgcacagccaggtgtcaggtgcgtctctgctgatctgagtccaccctgcagcatggacctgcatcttccctgaaggatctccagggctggagggacgactgccatgccctacaggaaagacagccaggctcctgggagggcagttccacttcctgtgtggctgcagatgacaaaaccccatgagaagaaggaccgagcctccaagtgtccacaccctgtgtgtcctctgtcctgccagcaccgagggctcatccatccacagagcagtgcagtgggaggagacgccatgacccccatcctcacggtcctgatctgtctcgggctgagcctggaccccaggacccacgtgcaggcagggcccctccccaagcccaccctctgggctgagccaggctctgtgatcacccaagggagtcctgtgaccctcaggtgtcaggggagcctggagacgcaggagtaccatctatatagagaaaagaaaacagcactctggattacacggatcccacaggagcttgtgaagaagggccagttccccatcctatccatcacctgggaacatgcagggcggtattgctgtatctatggcagccacactgcag

SEQ ID NO: 148584 - DNA, 664 bp, Homo sapiens
  Payload ID: 9415
  Gene Symbol: LILRA3
  Gene Name: leukocyte immunoglobulin-like receptor, subfamily A (without TM domain), member 3
  ENST ID: ENST00000616964
  CDS Start-End: 1-618
atgacccccatcctcacggtcctgatctgtctcgggctgagcctggaccccaggacccacgtgcaggcagggcccctccccaagcccaccctctgggctgagccaggctctgtgatcacccaagggagtcctgtgaccctcaggtgtcaggggagcctggagacgcaggagtaccatctatatagagaaaagaaaacagcactctggattacacggatcccacaggagcttgtgaagaagggccagttccccatcctatccatcacctgggaacatgcagggcggtattgctgtatctatggcagccacactgcaggcctctcatcaaagcgccaatctcataagtaccaggctgaattccccatgagtcctgtgacctcggcccacgcggggacctacaggtgctacggctcactcagctccaacccctacctgctgactcaccccagtgaccccctggagctcgtggtctcagcatccccaacctcacacccccaggattacacagtggagaatctcatccacatgggcaaggctggcttgatcctggtggtcctcaggattctgttatttgaggctcagcacagccagagaagccccgatgcagctaggaggtgaacagcagagaggacaatgcatctctcagagtggtggaaccttggga

SEQ ID NO: 148585 - DNA, 467 bp, Homo sapiens
  Payload ID: 9415
  Gene Symbol: LILRA3
  Gene Name: leukocyte immunoglobulin-like receptor, subfamily A (without TM domain), member 3
  ENST ID: ENST00000611439
  CDS Start-End: 355-467
gcgtctctgctgacctgagtctgccctgcaccatggacctgcattttccctgaagcatctccacgacggatgagatgactggccatgggctgagtctgagcttcaggacccatgtgcaggcagggattaaggtgcagagggacggccaaggatgcaatgggcaccgaggaggcaggaaagactcagagctcagcctgggctgcacagccaggtgtcaggtgcgtctctgctgatctgagtccaccctgcagcatggacctgcatcttccctgaaggatctccagggctggagggacgactgccatgcaccgagggctcatccatccacagagcagtgcagtgggaggagacgccatgacccccatcctcacggtcctgatctgtctcgggctgagcctggaccccaggacccacgtgcaggcagggcccctccccaagcccaccctctgggctgagccaggctctgt

SEQ ID NO: 148586 - DNA, 1911 bp, Homo sapiens; identical to SEQ ID NO: 148580
  Payload ID: 9415
  Gene Symbol: LILRA3
  Gene Name: leukocyte immunoglobulin-like receptor, subfamily A (without TM domain), member 3
  ENST ID: ENST00000615416
  CDS Start-End: 184-1653

SEQ ID NO: 148587 - DNA, 481 bp, Homo sapiens; identical to SEQ ID NO: 148581
  Payload ID: 9415
  Gene Symbol: LILRA3
  Gene Name: leukocyte immunoglobulin-like receptor, subfamily A (without TM domain), member 3
  ENST ID: ENST00000620042
  CDS Start-End: 369-481

SEQ ID NO: 148588 - DNA, 1604 bp, Homo sapiens
  Payload ID: 9415
  Gene Symbol: LILRA3
  Gene Name: leukocyte immunoglobulin-like receptor, subfamily A (without TM domain), member 3
  Uniprot ID: Q8N6C8
  ENST ID: ENST00000620589
  CDS Start-End: 93-1412
gagcctccaagtgtccacaccctgtgtgtcctctgtcctgccagcaccgagggctcatccatccacagagcagtgcagtgggaggagacgccatgacccccatcctcacggtcctgatctgtctcgggctgagcctggaccccaggacccacgtgcaggcagggcccctccccaagcccaccctctgggctgagccaggctctgtgatcacccaagggagtcctgtgaccctcaggtgtcaggggagcctggagacgcaggagtaccatctatatagagaaaagaaaacagcactctggattacacggatcccacaggagcttgtgaagaagggccagttccccatcctatccatcacctgggaacatgcagggcggtattgctgtatctatggcagccacactgcaggcctctcagagagcagtgaccccctggagctggtggtgacaggagcctacagcaaacccaccctctcagctctgcccagccctgtggtgacctcaggagggaatgtgaccatccagtgtgactcacaggtggcatttgatggcttcattctgtgtaaggaaggagaagatgaacacccacaatgcctgaactcccattcccatgcccgtgggtcatcccgggccatcttctccgtgggccccgtgagcccaagtcgcaggtggtcgtacaggtgctatggttatgactcgcgcgctccctatgtgtggtctctacccagtgatctcctggggctcctggtcccaggtgtttctaagaagccatcactctcagtgcagccgggtcctgtcgtggcccctggggagaagctgaccttccagtgtggctctgatgccggctacgacagatttgttctgtacaaggagtggggacgtgacttcctccagcgccctggccggcagccccaggctgggctctcccaggccaacttcaccctgggccctgtgagccgctcctacgggggccagtacacatgctccggtgcatacaacctctcctccgagtggtcggcccccagcgaccccctggacatcctgatcacaggacagatccgtgccagacccttcctctccgtgcggccgggccccacagtggcctcaggagagaacgtgaccctgctgtgtcagtcacagggagggatgcacactttccttttgaccaaggagggggcagctgattccccgctgcgtctaaaatcaaagcgccaatctcataagtaccaggctgaattccccatgagtcctgtgacctcggcccacgcggggacctacaggtgctacggctcactcagctccaacccctacctgctgactcaccccagtgaccccctggagctcgtggtctcaggagcagctgagaccctcagcccaccacaaaacaagtccgactccaaggctggtgagtgaggagatgcttgccgtgatgacgctgggcacagagggtcaggtcctgtcaagaggagctgggtgtcctgggtggacatttgaagaattatattcattccaacttgaagaattattcaacacctttaacaatgtatatgtgaagtactttattctttcatattttaaaaataaaagataattatccatgagaaa

SEQ ID NO: 148589 - DNA, 1604 bp, Homo sapiens; identical to SEQ ID NO: 148588
  Payload ID: 9415
  Gene Symbol: LILRA3
  Gene Name: leukocyte immunoglobulin-like receptor, subfamily A (without TM domain), member 3
  ENST ID: ENST00000619638
  CDS Start-End: 93-1412

SEQ ID NO: 148590 - DNA, 1604 bp, Homo sapiens; identical to SEQ ID NO: 148588
  Payload ID: 9415
  Gene Symbol: LILRA3
  Gene Name: leukocyte immunoglobulin-like receptor, subfamily A (without TM domain), member 3
  Uniprot ID: Q8N6C8
  ENST ID: ENST00000615652
  CDS Start-End: 93-1412

SEQ ID NO: 148591 - DNA, 1911 bp, Homo sapiens; identical to SEQ ID NO: 148580
  Payload ID: 9415
  Gene Symbol: LILRA3
  Gene Name: leukocyte immunoglobulin-like receptor, subfamily A (without TM domain), member 3
  ENST ID: ENST00000617121
  CDS Start-End: 184-1653

SEQ ID NO: 148592 - DNA, 1604 bp, Homo sapiens; identical to SEQ ID NO: 148588
  Payload ID: 9415
  Gene Symbol: LILRA3
  Gene Name: leukocyte immunoglobulin-like receptor, subfamily A (without TM domain), member 3
  Uniprot ID: Q8N6C8
  ENST ID: ENST00000612127
  CDS Start-End: 93-1412

SEQ ID NO: 148593 - DNA, 1911 bp, Homo sapiens; identical to SEQ ID NO: 148580
  Payload ID: 9415
  Gene Symbol: LILRA3
  Gene Name: leukocyte immunoglobulin-like receptor, subfamily A (without TM domain), member 3
  ENST ID: ENST00000610381
  CDS Start-End: 184-1653

SEQ ID NO: 148594 - DNA, 2774 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000324602
  CDS Start-End: 166-2124
ctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacacacagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctgcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatt

SEQ ID NO: 148595 - DNA, 2157 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000396315
  CDS Start-End: 1-1959
atgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacacacagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctgcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataa

SEQ ID NO: 148596 - DNA, 2103 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000396317
  CDS Start-End: 1-1905
atgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacacacagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcagcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataa

SEQ ID NO: 148597 - DNA, 2878 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000396327
  CDS Start-End: 273-2228
ggggactatttggttgaaagaaaacccacaatccagtgtcaagaaagaagtcaacttttcttccctatttccctgcatttctcttctgtgctcactgccacacgcagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacacacagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctgcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatt

SEQ ID NO: 148598 - DNA, 2960 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000396331
  CDS Start-End: 358-2310
gagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacacacagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatt

SEQ ID NO: 148599 - DNA, 2776 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000396332
  CDS Start-End: 171-2126
cgcagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacacacagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatt

SEQ ID NO: 148600 - DNA, 2751 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000427581
  CDS Start-End: 334-2439
ggtaaggaccccacaacactgagctgatggacggctgaaggagggagggtgaccatgtgggaggctgtgagaaggaaggagatgcctccgctaccctcgtcaggaagggcagacacaggaaggaaccagttttatttgctgctacatcctggctctcagtgggatgaaaacaaaccagacagacggtggctgggggtcaggaaagggcccattaccatctgaaatgatgcagagggcctagtgactgcccccacctcagccctaatggaatgagagcaagggtcctggggagggcagttccacttcctgtgtggctgcagatgacagcaccccatgagaagaaggacccagcctccgattggccacactctgtgtgtctctctatcctgccagcaccgagggctcatccatccacagagcagggcagtgggaggagacgccatgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacacacagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctgcaggccctgaggaccagcccctcacccccaccgggtcggatccccagagtgctccggggctcggctctggtgcaggaacaagggctgcaggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaatt

SEQ ID NO: 148601 - DNA, 2075 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000421584
  CDS Start-End: 1-1533
atgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacacacagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgagtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataa

SEQ ID NO: 148602 - DNA, 2365 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000613400
  CDS Start-End: 1-2053
ctgccagcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctgcaggccctgaggaccagcccctcacccccaccgggtcggatccccagagtgctccggggctcggctctggtgcaggaacaagggctgcaggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaatt

SEQ ID NO: 148603 - DNA, 2425 bp, Homo sapiens
  Payload ID: 9416
  Gene Symbol: LILRB1
  Gene Name: leukocyte immunoglobulin-like receptor, subfamily B (with TM and ITIM domains), member 1
  Uniprot ID: Q8NHL6
  ENST ID: ENST00000617686
  CDS Start-End: 171-2126
cgcagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagtgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccac

SEQ ID NO: 148604 - DNA, 2425 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000619093
  CDS Start-End: 171-2126
cgcagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgacccttagacggaaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccac

SEQ ID NO: 148605 - DNA, 854 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000610532
  CDS Start-End: 1-204
gaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatt

SEQ ID NO: 148606 - DNA, 1507 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000620234
  CDS Start-End: 1-1458
atgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagtgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggagcagctgataccctcagcccatcacaaaacaagtctgactctgagactgcatccccagcctcacaccttcaggattacgcagtggagaatctcatccacatgggcgtggctggcttgatcctggtggtcctcgggattctgtcatttgaggcttggcacagccagagaagcttccaagatgcagccgggaggtgaacagcagagaggataatgtactttatagagtcgtgaagcctcaggaaca

SEQ ID NO: 148607 - DNA, 2781 bp, Homo sapiens
  Payload ID: 9416
  Gene Symbol: LILRB1
  Gene Name: leukocyte immunoglobulin-like receptor, subfamily B (with TM and ITIM domains), member 1
  Uniprot ID: Q8NHL6
  ENST ID: ENST00000618681
  CDS Start-End: 176-2131
ccacacgcagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagtgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctgcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatt

SEQ ID NO: 148608 - DNA, 1959 bp, Homo sapiens
  Payload ID: 9416
  Gene Symbol: LILRB1
  Gene Name: leukocyte immunoglobulin-like receptor, subfamily B (with TM and ITIM domains), member 1
  Uniprot ID: Q8NHL6
  ENST ID: ENST00000612636
  CDS Start-End: 1-1959
atgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagtgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctgcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactag

SEQ ID NO: 148609 - DNA, 1507 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000621547
  CDS Start-End: 1-1458
atgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggagcagctgataccctcagcccatcacaaaacaagtctgactctgagactgcatccccagcctcacaccttcaggattacgcagtggagaatctcatccacatgggcgtggctggcttgatcctggtggtcctcgggattctgtcatttgaggcttggcacagccagagaagcttccaagatgcagccgggaggtgaacagcagagaggataatgtactttatagagtcgtgaagcctcaggaaca

SEQ ID NO: 148610 - DNA, 1507 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000618356
  CDS Start-End: 1-1458
atgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggagcagctgataccctcagcccatcacaaaacaagtctgactctgagactgcatccccagcctcacaccttcaggattacgcagtggagaatctcatccacatgggcgtggctggcttgatcctggtggtcctcgggattctgtcatttgaggcttggcacagccagagaagcttccaagatgcagccgggaggtgaacagcagagaggataatgtactttatagagtcgtgaagcctcaggaaca

SEQ ID NO: 148611 - DNA, 204 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000616890
  CDS Start-End: 1-204
gaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactag

SEQ ID NO: 148612 - DNA, 1458 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000615311
  CDS Start-End: 39-1409
tcatccatccacagagcagggcagtgggaggagacgccatgacccccatcctcacggtcctgatctgtctcgggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcagcatccccagcctcacaccttcaggattacgcagtggagaatctcatccacatgggcgtggctggcttgatcctggtggtcctcgggattctgtcatttgaggcttggcacagccagagaagcttccaagatgcagccgggaggtgaacagcagagaggataatgtactttatagagtcgtgaagcctcaggaaca

SEQ ID NO: 148613 - DNA, 2984 bp, Homo sapiens
  Payload ID: 9416
  Gene Symbol: LILRB1
  Gene Name: leukocyte immunoglobulin-like receptor, subfamily B (with TM and ITIM domains), member 1
  Uniprot ID: Q8NHL6
  ENST ID: ENST00000618055
  CDS Start-End: 341-2293
gaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagtgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaattaaaaaaaaaaaaaaaaaagaaagaaaaagagaaaaaagaaa

SEQ ID NO: 148614 - DNA, 2017 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000620471
  CDS Start-End: 1-1532
tgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgagtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgc

SEQ ID NO: 148615 - DNA, 3216 bp, Homo sapiens
  Payload ID: 9416
  Gene Symbol: LILRB1
  Gene Name: leukocyte immunoglobulin-like receptor, subfamily B (with TM and ITIM domains), member 1
  Uniprot ID: Q8NHL6
  ENST ID: ENST00000616408
  CDS Start-End: 586-2538
aaatgagttttaaaaaggcttgtccaggaagcacatatgggagctggtcactctgcattttgggccctcctggaggtgtttagaccttccgagagagaaactgagacacatgagagggaagaaatgactcagtggtgagaccctgtggagtcccacccacaaccagcacactgtgacccactgcacaaacctctagcccacagctcacttcctcctttaagaagagaagagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgacccttagacggaaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaattaaaaaaaaaaaaaaaaaagaaagaaaaa

SEQ ID NO: 148616 - DNA, 2835 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000610641
  CDS Start-End: 141-2144
tcttctgtgctcgctgccacacgcagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaattaaaaaaaaaaaaaaaaaagaaagaaaaagagaaaaaagaaa

SEQ ID NO: 148617 - DNA, 2774 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000619395
  CDS Start-End: 166-2124
ctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctgcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgacccttagacggaaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatt

SEQ ID NO: 148618 - DNA, 2018 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000612335
  CDS Start-End: 1-1533
atgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagtgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgagtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgc

SEQ ID NO: 148619 - DNA, 1959 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000620642
  CDS Start-End: 1-1959
atgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctgcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgacccttagacggaaggcaactgagcctcctccatcccaggaagggccctctccagctgtgcccagcatctacgccactctggccatccactag

SEQ ID NO: 148620 - DNA, 2720 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000616565
  CDS Start-End: 166-2070
ctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagtgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcagcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatt

SEQ ID NO: 148621 - DNA, 503 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000610815
  CDS Start-End: 1-204
gaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccac

SEQ ID NO: 148622 - DNA, 2425 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000611295
  CDS Start-End: 120-2126
cgcagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccac

SEQ ID NO: 148623 - DNA, 1958 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000610752
  CDS Start-End: 1-1958
tgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctgcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactag

SEQ ID NO: 148624 - DNA, 895 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000619118
  CDS Start-End: 1-204
gaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaattaaaaaaaaaaaaaaaaaagaaagaaaaagagaaaaaagaaa

SEQ ID NO: 148625 - DNA, 1458 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000614951
  CDS Start-End: 39-1409
tcatccatccacagagcagggcagtgggaggagacgccatgacccccatcctcacggtcctgatctgtctcgggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagtgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcagcatccccagcctcacaccttcaggattacgcagtggagaatctcatccacatgggcgtggctggcttgatcctggtggtcctcgggattctgtcatttgaggcttggcacagccagagaagcttccaagatgcagccgggaggtgaacagcagagaggataatgtactttatagagtcgtgaagcctcaggaaca

SEQ ID NO: 148626 - DNA, 2430 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000615841
  CDS Start-End: 148-2154
gcatttctcttctgtgctcgctgccacacgcagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctgcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgat

SEQ ID NO: 148627 - DNA, 2804 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000613145
  CDS Start-End: 199-2154
gcatttctcttctgtgctcactgccacacgcagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctgcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgacccttagacggaaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatt

SEQ ID NO: 148628 - DNA, 2720 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000615004
  CDS Start-End: 166-2070
ctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcagcaggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaatt

SEQ ID NO: 148629 - DNA, 670 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000625929
  CDS Start-End: 1-621
atgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcatcagagcacggagctcagcagcaccaggctgaattccccatgagtcctgtgacctcagcccacacggggacctacaggtgctacggctcactcagctccgacccctacctgctgtctcaccccagtggccccgtggagctcgtggtctcagcatccccagcctcacaccttcaggattacgcagtggagaatctcatccacatgggcgtggctggcttgatcctggtggtcctcgggattctgtcatttgaggcttggcacagccagagaagcttccaagatgcagccgggaggtgaacagcagagaggataatgtactttatagagtcgtgaagcctcaggaaca

SEQ ID NO: 148630 - DNA, 670 bp, Homo sapiens; identical to SEQ ID NO: 148629
  Payload ID: 9416
  Gene Symbol: LILRB1
  Gene Name: leukocyte immunoglobulin-like receptor, subfamily B (with TM and ITIM domains), member 1
  ENST ID: ENST00000625537
  CDS Start-End: 1-621

SEQ ID NO: 148631 - DNA, 670 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000625885
  CDS Start-End: 1-621
atgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacatgcagggcggtatcgctgttactatggtagcgacactgcaggccgctcatcagagcacggagctcagcagcaccaggctgaattccccatgagtcctgtgacctcagcccacacggggacctacaggtgctacggctcactcagctccgacccctacctgctgtctcaccccagtggccccgtggagctcgtggtctcagcatccccagcctcacaccttcaggattacgcagtggagaatctcatccacatgggcgtggctggcttgatcctggtggtcctcgggattctgtcatttgaggcttggcacagccagagaagcttccaagatgcagccgggaggtgaacagcagagaggataatgtactttatagagtcgtgaagcctcaggaaca

SEQ ID NO: 148632 - DNA, 1458 bp, Homo sapiens
  Payload ID: 9416
  Gene Symbol: LILRB1
  Gene Name: leukocyte immunoglobulin-like receptor, subfamily B (with TM and ITIM domains), member 1
  ENST ID: ENST00000629125
  CDS Start-End: 39-1409
tcatccatccacagagcagggcagtgggaggagacgccatgacccccatcctcacggtcctgatctgtctcgggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcagcatccccagcctcacaccttcaggattacgcagtggagaatctcatccacatgggcgtggctggcttgatcctggtggtcctcgggattctgtcatttgaggcttggcacagccagagaagcttccaagatgcagccgggaggtgaacagcagagaggataatgtactttatagagtcgtgaagcctcaggaaca

SEQ ID NO: 148633 - DNA, 2397 bp, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENST ID: ENST00000314446
  CDS Start-End: 273-2066
gggactatttggttgaaagaaaacccacaatccagtgtcaagaaagaagtcaacttttcttcccctacttccctgcatttctcctctgtgctcactgccacacacagctcaacctggacagcacagccagaggcgagatgcttctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccgcgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcatggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatg

SEQ ID NO: 148634 - DNA, 1940 bp, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENST ID: ENST00000391746
  CDS Start-End: 3-1535
ccatgacccccatcgtcacagtcctgatctgtctcgggctgagtctgggccccaggacccgcgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcatggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgagtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataa

SEQ ID NO: 148635 - DNA, 2784 bp, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENST ID: ENST00000391748
  CDS Start-End: 129-1922
ggggaagccactgctaccctcatcaggaagggcagacacaagaagcaccagttctatttgctgctacatcccggctctcgcaccgagggctcatccatccgcagagcagggcagtgggaggagacgccatgacccccatcgtcacagtcctgatctgtctcgggctgagtctgggccccaggacccgcgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcatggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatgaaaaaagtagaaacgaaaaaaaaaaactaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgtgaaaaacattgactgtaataaaaatgttcccatcgta

SEQ ID NO: 148636 - DNA, 2286 bp, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENST ID: ENST00000391749
  CDS Start-End: 273-2069
gggactatttggttgaaagaaaacccacaatccagtgtcaagaaagaagtcaacttttcttcccctacttccctgcatttctcctctgtgctcactgccacacacagctcaacctggacagcacagccagaggcgagatgcttctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccgcgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcatggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataa

SEQ ID NO: 148637 - DNA, 1058 bp, Homo sapiens
  Payload ID: 9417
  Gene Symbol: LILRB2
  Gene Name: leukocyte immunoglobulin-like receptor, subfamily B (with TM and ITIM domains), member 2
  ENST ID: ENST00000455108
  CDS Start-End: 1-632
ccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctgtgagtgagaggaagagatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataa

SEQ ID NO: 148638 - DNA, 2773 bp, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENST ID: ENST00000434421
  CDS Start-End: 464-1912
atttggttgaaagaaaacccacaatccagtgtcaagaaagaagtcaacttttcttcccctacttccctgcatttctcctctgtgctcactgccacacacagctcaacctggacagcacagccagaggcgagatgcttctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcatggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatgaaaaaagtagaaacgaaaaaaaaaaactaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgtgaaaaacattgactgtaataaaaatgttcccatcgt

SEQ ID NO: 148639 - DNA, 917 bp, Homo sapiens
  Payload ID: 9417
  Gene Symbol: LILRB2
  Gene Name: leukocyte immunoglobulin-like receptor, subfamily B (with TM and ITIM domains), member 2
  ENST ID: ENST00000616216
  CDS Start-End: 1-660
gaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaa

SEQ ID NO: 148640 - DNA, 988 bp, Homo sapiens
  Payload ID: 9417
  Gene Symbol: LILRB2
  Gene Name: leukocyte immunoglobulin-like receptor, subfamily B (with TM and ITIM domains), member 2
  ENST ID: ENST00000617643
  CDS Start-End: 1-657
gaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatg

SEQ ID NO: 148641 - DNA, 2782 bp, Homo sapiens
  Payload ID: 9417
  Gene Symbol: LILRB2
  Gene Name: leukocyte immunoglobulin-like receptor, subfamily B (with TM and ITIM domains), member 2
  ENST ID: ENST00000621989
  CDS Start-End: 129-1922
ggggaagccactgctaccctcatcaggaagggcagacacaagaagcaccagttctatttgctgctacatcccggctctcgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcatacaacctctcctccgagtggtcggcccccagcgaccccctggacatcctgatcacaggacagatccatggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcaacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaggggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatgaaaaaagtagaaacgaaaaaaaaaaactaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgaaaaacattgactgtaataaaaatgttcccatcgta

SEQ ID NO: 148642 - DNA, 1058 bp, Homo sapiens; identical to SEQ ID NO: 148637
  Payload ID: 9417
  Gene Symbol: LILRB2
  Gene Name: leukocyte immunoglobulin-like receptor, subfamily B (with TM and ITIM domains), member 2
  ENST ID: ENST00000613933
  CDS Start-End: 1-632

SEQ ID NO: 148643 - DNA, 346 bp, Homo sapiens
  Payload ID: 9417
  Gene Symbol: LILRB2
  Gene Name: leukocyte immunoglobulin-like receptor, subfamily B (with TM and ITIM domains), member 2
  ENST ID: ENST00000620441
  CDS Start-End: 234-346
caggaattgaggtgcagagggacggctaaggacgcaatgggcaccgaggaggcaggaaagactcagagctcagcctgggcggcacagccagatgcgagatgcgtctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgt

SEQ ID NO: 148644 - DNA, 2210 bp, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENST ID: ENST00000618392
  CDS Start-End: 157-1953
gacggcacagccagatgcgagatgcgtctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcatacaacctctcctccgagtggtcggcccccagcgaccccctggacatcctgatcacaggacagatccatggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcaacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaggggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaa

SEQ ID NO: 148645 - DNA, 2361 bp, Homo sapiens
  Payload ID: 9417
  Gene Symbol: LILRB2
  Gene Name: leukocyte immunoglobulin-like receptor, subfamily B (with TM and ITIM domains), member 2
  ENST ID: ENST00000613032
  CDS Start-End: 222-2030
gggactatttggttgaaagaaaacccacaatccagtgtcaagaaagaagtcaacttttcttcccctacttccctgcatttctcctctgtgctcactgccacacgcagctcaacctggacggcacagccagaggcgagatgcttctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggaccattcccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagaagaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatg

SEQ ID NO: 148646 - DNA, 2773 bp, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENST ID: ENST00000614225
  CDS Start-End: 464-1912
atttggttgaaagaaaacccacaatccagtgtcaagaaagaagtcaacttttcttcccctacttccctgcatttctcctctgtgctcactgccacacgcagctcaacctggacggcacagccagaggcgagatgcttctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagaagaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatgaaaaaagtagaaacgaaaaaaaaaaactaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgtgaaaaacattgactgtaataaaaatgttcccatcgt

SEQ ID NO: 148647 - DNA, 2924 bp, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENST ID: ENST00000618705
  CDS Start-End: 267-2063
atttggttgaaagaaaacccacaatccagtgtcaagaaagaagtcaacttttcttcccctacttccctgcatttctcctctgtgctcactgccacacgcagctcaacctggacggcacagccagaggcgagatgcttctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccattcccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagaagaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatgaaaaaagtagaaacgaaaaaaaaaaactaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgtgaaaaacattgactgtaataaaaatgttcccatcgt

SEQ ID NO: 148648 - DNA, 1904 bp, Homo sapiens
  Payload ID: 9417
  Gene Symbol: LILRB2
  Gene Name: leukocyte immunoglobulin-like receptor, subfamily B (with TM and ITIM domains), member 2
  ENST ID: ENST00000621522
  CDS Start-End: 3-1499
ccatgacccccatcgtcacagtcctgatctgtctcgggaccattcccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagaagaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgagtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataa

SEQ ID NO: 148649 - DNA, 1892 bp, Homo sapiens
  Payload ID: 9417
  Gene Symbol: LILRB2
  Gene Name: leukocyte immunoglobulin-like receptor, subfamily B (with TM and ITIM domains), member 2
  ENST ID: ENST00000613437
  CDS Start-End: 3-1535
ccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcatacaacctctcctccgagtggtcggcccccagcgaccccctggacatcctgatcacaggacagatccatggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcaagtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaggggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaat

SEQ ID NO: 148650 - DNA, 1892 bp, Homo sapiens
  Payload ID: 9417
  Gene Symbol: LILRB2
  Gene Name: leukocyte immunoglobulin-like receptor, subfamily B (with TM and ITIM domains), member 2
  ENST ID: ENST00000621542
  CDS Start-End: 3-1535
ccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcatacaacctctcctccgagtggtcggcccccagcgaccccctggacatcctgatcacaggacagatccatggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgagtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaat

SEQ ID NO: 148651 - DNA, 2299 bp, Homo sapiens
  Payload ID: 9417
  Gene Symbol: LILRB2
  Gene Name: leukocyte immunoglobulin-like receptor, subfamily B (with TM and ITIM domains), member 2
  ENST ID: ENST00000610367
  CDS Start-End: 175-1968
cacacgcagctcaacctggacggcacagccagatgcgagatgcgtctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcatacaacctctcctccgagtggtcggcccccagcgaccccctggacatcctgatcacaggacagatccatggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcaacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaggggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatg

SEQ ID NO: 148652 - DNA, 2748 bp, Homo sapiens
  Payload ID: 9417
  Gene Symbol: LILRB2
  Gene Name: leukocyte immunoglobulin-like receptor, subfamily B (with TM and ITIM domains), member 2
  ENST ID: ENST00000615641
  CDS Start-End: 129-1886
ggggaagccactgctaccctcatcaggaagggcagacacaagaagcaccagttctatttgctgctacatcccggctctcgcaccgagggctcatccatccgcagagcagggcagtgggaggagacgccatgacccccatcgtcacagtcctgatctgtctcgggaccattcccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagaagaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatgaaaaaagtagaaacgaaaaaaaaaaactaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgtgaaaaacattgactgtaataaaaatgttcccatcgta

SEQ ID NO: 148653 - DNA, 1517 bp, Homo sapiens
  Payload ID: 9417
  Gene Symbol: LILRB2
  Gene Name: leukocyte immunoglobulin-like receptor, subfamily B (with TM and ITIM domains), member 2
  ENST ID: ENST00000614965
  CDS Start-End: 1-657
gaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatgaaaaaagtagaaacgaaaaaaaaaaactaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgaaaaacattgactgtaataaaaatgttcccatcgta

SEQ ID NO: 148654 - DNA, 2299 bp, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENST ID: ENST00000610886
  CDS Start-End: 175-1968
cacacgcagctcagcctgggcggcacagccagatgcgagatgcgtctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcatacaacctctcctccgagtggtcggcccccagcgaccccctggacatcctgatcacaggacagatccatggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatg

SEQ ID NO: 148655 - DNA, 2783 bp, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENST ID: ENST00000621020
  CDS Start-End: 129-1922
ggggaagccactgctaccctcatcaggaagggcagacacaagaagcaccagttctatttgctgctacatcccggctctcgcaccgagggctcatccatccgcagagcagggcagtgggaggagacgccatgacccccatcgtcacagtcctgatctgtctcgggctgagtctgggccccaggacccacgtgcagacagggaccattcccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagaagaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatgaaaaaagtagaaacgaaaaaaaaaaactaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgtgaaaaacattgactgtaataaaaatgttcccatcgt

SEQ ID NO: 148656 - DNA, 2623 bp, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENST ID: ENST00000619122
  CDS Start-End: 42-1574
ggctcatccatccgcagagcagggcagtgggaggagacgccatgacccccatcgtcacagtcctgatctgtctcgggctgagtctgggccccaggacccacgtgcagacagggaccattcccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagaagaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgagtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatgaaaaaagtagaaacgaaaaaaaaaaactaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgtgaaaaacattgactgtaataaaaatgttcccatcgt

SEQ ID NO: 148657 - DNA, 2321 bp, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENST ID: ENST00000617886
  CDS Start-End: 268-2064
tatttggttgaaagaaaacccacaatccagtgtcaagaaagaagtcaacttttcttcccctacttccctgcatttctcctctgtgctcactgccacacgcagctcagcctgggcggcacagccagatgcgagatgcgtctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcatacaacctctcctccgagtggtcggcccccagcgaccccctggacatcctgatcacaggacagatccatggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaa

SEQ ID NO: 148658 - DNA, 2250 bp, Homo sapiens
  Payload ID: 9417
  Gene Symbol: LILRB2
  Gene Name: leukocyte immunoglobulin-like receptor, subfamily B (with TM and ITIM domains), member 2
  ENST ID: ENST00000617081
  CDS Start-End: 222-2033
gggactatttggttgaaagaaaacccacaatccagtgtcaagaaagaagtcaacttttcttcccctacttccctgcatttctcctctgtgctcactgccacacgcagctcaacctggacggcacagccagaggcgagatgcttctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggaccattcccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagaagaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataa

SEQ ID NO: 148659 - DNA, 1455 bp, Homo sapiens
  Payload ID: 9417
  Gene Symbol: LILRB2
  Gene Name: leukocyte immunoglobulin-like receptor, subfamily B (with TM and ITIM domains), member 2
  ENST ID: ENST00000612280
  CDS Start-End: 39-1406
tcatccatccgcagagcagggcagtgggaggagacgccatgacccccatcgtcacagtcctgatctgtctcgggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcatggcccctggggaaagcctgaccctccagtgtgtctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcagcatccccagcctcacacgccaaggattacacagtggagaatctcatccgcatgggcatggcaggcttggtcctggtgttcctcgggattctgttatttgaggctcagcacagccagagaaacccccaagatgcagccgggaggtgaacagcggagaggacaatgcacccttcagcgtggtggagcctcagggaca

SEQ ID NO: 148660 - DNA, 2782 bp, Homo sapiens
  Payload ID: 9417
  Gene Symbol: LILRB2
  Gene Name: leukocyte immunoglobulin-like receptor, subfamily B (with TM and ITIM domains), member 2
  Uniprot ID: Q8N423
  ENST ID: ENST00000617341
  CDS Start-End: 129-1922
ggggaagccactgctaccctcatcaggaagggcagacacaagaagcaccagttctatttgctgctacatcccggctctcgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcatacaacctctcctccgagtggtcggcccccagcgaccccctggacatcctgatcacaggacagatccatggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatgaaaaaagtagaaacgaaaaaaaaaaactaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgaaaaacattgactgtaataaaaatgttcccatcgta

SEQ ID NO: 148661 - DNA, 346 bp, Homo sapiens
  Payload ID: 9417
  Gene Symbol: LILRB2
  Gene Name: leukocyte immunoglobulin-like receptor, subfamily B (with TM and ITIM domains), member 2
  ENST ID: ENST00000620625
  CDS Start-End: 183-346
caggaattgaggtgcagagggacggctaaggacgcaatgggcaccgaggaggcaggaaagactcagagctcaacctggacggcacagccagatgcgagatgcgtctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgt

SEQ ID NO: 148662 - DNA, 2066 bp, Homo sapiens
  Payload ID: 9418
  Gene Symbol: LILRB3
  Gene Name: leukocyte immunoglobulin-like receptor, subfamily B (with TM and ITIM domains), member 3
  Uniprot ID: O75022
  ENST ID: ENST00000245620
  CDS Start-End: 3-1901
ccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagccgctcctacgggggccagtacaggtgctatggtgcacacaacctctcctccgagtggtcggcccccagtgaccccctggacatcctgatcacaggacagatctatgacaccgtctccctgtcagcacagccgggccccacagtggcctcaggagagaacatgaccctgctgtgtcagtcacgggggtattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctcctccgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgctgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148663 - DNA, 2204 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000346401
  CDS Start-End: 64-1995
ctgtcctgccagcactgagggctcatccctctgcagagcgcggggtcaccgggaggagacgccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagccgctcctacgggggccagtacaggtgctatggtgcacacaacctctcctccgagtggtcggcccccagtgaccccctggacatcctgatcacaggacagatctatgacaccgtctccctgtcagcacagccgggccccacagtggcctcaggagagaacatgaccctgctgtgtcagtcacgggggtattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctttccccagtgagcccctggaactcatggtctcaggtcctgaggaccagccccttaaccccccagggtcaggccctcagaatgctccgggtctcggctctggtgcaggaacaagggctgcaggtctgggaagatacctggaggttttgattggggtctcggtggccttcgtcctgctgctcttcctcctcctcttcctcctcctcctccgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgctgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaa

SEQ ID NO: 148664 - DNA, 2848 bp, Homo sapiens
  Payload ID: 9418
  Gene Symbol: LILRB3
  Gene Name: leukocyte immunoglobulin-like receptor, subfamily B (with TM and ITIM domains), member 3
  Uniprot ID: O75022
  ENST ID: ENST00000391750
  CDS Start-End: 138-2033
tgcgtctctgctgatctgagtctgcctgcagcatggacctgggtcttccctgaagcatctccagggctggagagacgactgccatgcactgagggctcatccctctgcagagcgcggggtcaccgggaggagacgccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagccgctcctacgggggccagtacaggtgctatggtgcacacaacctctcctccgagtggtcggcccccagtgaccccctggacatcctgatcacaggacagatctatgacaccgtctccctgtcagcacagccgggccccacagtggcctcaggagagaacatgaccctgctgtgtcagtcacgggggtattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctcctccgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgctgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaaaacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaatattatacatcgaacttatgacatgggaaaattaagaagcataaataggccgggcgcggtggctcacgcctataatctcagcactttgggaggctgatgcgggcggatcatgaggtcaggagatcgagaccatcctggctaacacggtgaaaccccgtctctactaaaaatacaaaaaaattagccgggcgtggtggcgagtgcctatagtcccagctactcaggaggctgaggcaggagaatggcatgagcccgggaggcagagcttgcagtgagctgagatcgcaccactgcactccagcctgggcgacagagtgagattccgtctcgaaaaaaaaaaaaaaagaaagaaaaaaaataaaaaagaagcataaccagg

SEQ ID NO: 148665 - DNA, 586 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000445347
  CDS Start-End: 112-586
atgacaagaaggacccagcctccgagcggccacaccctgtgtgtctctctgtcctgccagcactgagggctcatccctctgcagagcgcggggtcaccgggaggagacgccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaag

SEQ ID NO: 148666 - DNA, 2400 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000414379
  CDS Start-End: 3-578
ccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacagctgacaggttgtggggagtttggctggtgactgaatctggaaaggacccagagtgatgtgttgaaggacgggctgaaggcatgagggagaccccatggggaggctctgacatgggaggaggagcccttgaccacgttcacctggaaggggaggactcaggaaggcatcggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagccgctcctacgggggccagtacaggtgctatggtgcacacaacctctcctccgagtggtcggcccccagtgaccccctggacatcctgatcacaggacagatctatgacaccgtctccctgtcagcacagccgggccccacagtggcctcaggagagaacatgaccctgctgtgtcagtcacgggggtattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctcctccgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgctgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaaaacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaa

SEQ ID NO: 148667 - DNA, 2170 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000614251
  CDS Start-End: 50-1945
ctgagggctcatccctctgcagagcgcggggtcaccggaaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaat

SEQ ID NO: 148668 - DNA, 2132 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000613833
  CDS Start-End: 54-1949
agcactgagggctcatccctctgcagagcgccgggtcaccgggaggagacgccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaagggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagccgctcctacgggggccagtacaggtgctatggtgcacacaacctctcctccgagtggtcggcccccagtgaccccctggacatcctgatcacaggacagatctatgacaccgtctccctgtcagcacagccgggccccacagtggcctcaggagagaacgtgaccctgctgtgtcagtcacgggggtattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgctgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattt

SEQ ID NO: 148669 - DNA, 2419 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000610675
  CDS Start-End: 3-578
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagccaggaggcccaggagtaccgactgcataaagagggaagcccagagcccttggacagaaataacccactggaacccaagaacaaggccagattctccatcccatccatgacagagcaccatgcagggagataccgctgccactattacagctctgcaggctggtcagagcccagcgaccccctggagatggtgatgacaggagcctacagcaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtcgggggttccaggccctgttccctgtgggccccgtgacccccagccacagctgacaggttgtggggagtttggctggtgactgaatctggaaaggacccagagtgatgtgttgaaggacgggctgaaggcatgagggagaccccatggggaggctctgacatgggaggaggagccctcgaccacgttcacctggaaggggaggactcaggaaggcatcggcgtgtctaggaagccctccctcctgaccctgcagggccctgtcctggcccctgggcagagcctgaccctccagtgtggctctgatgtcggctacaacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaaaacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaata

SEQ ID NO: 148670 - DNA, 2066 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000615764
  CDS Start-End: 3-1901
ccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaagggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagccgctcctacgggggccagtacaggtgctatggtgcacacaacctctcctccgagtggtcggcccccagtgaccccctggacatcctgatcacaggacagatctatgacaccgtctccctgtcagcacagccgggccccacagtggcctcaggagagaacgtgaccctgctgtgtcagtcacgggggtattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgctgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148671 - DNA, 2126 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000612057
  CDS Start-End: 3-1901
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccgactggataaagagggaagcccagagcccttggacagaaataacccactggaacccaagaacaaggccagattctccatcccatccatgacagagcaccatgcggggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccaggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaat

SEQ ID NO: 148672 - DNA, 2066 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000613084
  CDS Start-End: 3-1901
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccaggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148673 - DNA, 2114 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000615995
  CDS Start-End: 3-1949
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccaggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggaggtcctgaggaccagccccttaaccccccagggtcaggccctcagaatggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148674 - DNA, 2487 bp, Homo sapiens
  Payload ID: 9418
  Gene Symbol: LILRB3
  Gene Name: leukocyte immunoglobulin-like receptor, subfamily B (with TM and ITIM domains), member 3
  Uniprot ID: O75022
  ENST ID: ENST00000613698
  CDS Start-End: 191-2086
acttcagccctggggaaatcagagccaggttcctggggtggcagttcctcttcctgtgggctgaggatgagacaaccccatgacaagaaggacccagcctccgagcggccacaccctgtgtgtctctctgtcctgccagcactgagggctcatccctctgcagagcgcggggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccgactggataaagagggaagcccagagcccttggacagaaataacccactggaacccaagaacaaggccagattctccatcccatccatgacagagcaccatgcggggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccaggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaaaacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaa

SEQ ID NO: 148675 - DNA, 2114 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000621660
  CDS Start-End: 3-1949
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagccaggaggcccaggagtaccgactgcataaagagggaagcccagagcccttggacagaaataacccactggaacccaagaacaaggccagattctccatcccatccatgacagagcaccatgcagggagataccgctgccactattacagctctgcaggctggtcagagcccagcgaccccctggagatggtgatgacaggagcctacagcaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtcgggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacaacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggacactctggaggctccagcctcccacccacagggccgccctccacacctggaggtcctgaggaccagccccttaaccccccagggtcaggccctcagaatcgtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148676 - DNA, 1983 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000617197
  CDS Start-End: 3-590
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagccgctcctacgggggccagtacaggtgctatggtgcacacaacctctcctccgagtggtcggcccccagtgaccccctggacatcctgatcacaggacagatctatgacaccgtctccctgtcagcacagccgggccccacagtggcctcaggagagaacgtgaccctgctgtgtcagtcacgggggtattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgctgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148677 - DNA, 2117 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000615387
  CDS Start-End: 3-1952
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccgactggataaagagggaagcccagagcccttggacagaaataacccactggaacccaagaacaaggccagattctccatcccatccatgacagagcaccatgcggggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccaggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggaggtcctgaggaccagccccttaaccccccagggtcaggccctcagaatggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148678 - DNA, 2091 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000614546
  CDS Start-End: 3-1472
ccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaagggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagccgctcctacgggggccagtacaggtgctatggtgcacacaacctctcctccgagtggtcggcccccagtgaccccctggacatcctgatcacaggacagatctatgacaccgtctccctgtcagcacagccgggccccacagtggcctcaggagagaacgtgaccctgctgtgtcagtcacgggggtattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgggctgagactctgtccatcttcacccagaccagagaaagactgatttccagcgtcctgcaggggctgcggagacagagcccaaggacaggggcctgctgaggaggtccagcccagctgctgacgtccaggaagaaaacctctatgctgctgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148679 - DNA, 2114 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000622537
  CDS Start-End: 3-1949
ccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaagggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagccgctcctacgggggccagtacaggtgctatggtgcacacaacctctcctccgagtggtcggcccccagtgaccccctggacatcctgatcacaggacagatctatgacaccgtctccctgtcagcacagccgggccccacagtggcctcaggagagaacgtgaccctgctgtgtcagtcacgggggtattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctttccccagtgagcccctggaactcatggtctcaggacactctggaggctccagcctcccacccacagggccgccctccacacctggaggtcctgaggaccagccccttaaccccccagggtcaggccctcagaatggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgctgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148680 - DNA, 2825 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000610647
  CDS Start-End: 112-2010
atgacaagaaggacccagcctccgagcggccacaccctgtgtgtctctctgtcctgccagcactgagggctcatccctctgcagagcgccgggtcaccgggaggagacgccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaagggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagccgctcctacgggggccagtacaggtgctatggtgcacacaacctctcctccgagtggtcggcccccagtgaccccctggacatcctgatcacaggacagatctatgacaccgtctccctgtcagcacagccgggccccacagtggcctcaggagagaacgtgaccctgctgtgtcagtcacgggggtattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgctgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaaaacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaactgaatgataatgtaaatattatacatcgaacttatgacatgggaaaattaagaagcataaataggccgggcgcggtggctcacgcctataatctcagcactttgggaggctgatgcgggcggatcatgaggtcaggagatcgagaccatcctggctaacacggtgaaaccccgtctctactaaaaatacaaaaaaattagccgggcgtggtggcgagtgcctatagtcccagctactcaggaggctgaggcaggagaatggcatgagcccgggaggcagagcttgcagtgagctgagatcgcaccactgcactccagcctgggcgacagagtgagattccgtctcgaaaaaaaaaaaaaaagaaagaaaaaaaataaaaaagaagcataaccagg

SEQ ID NO: 148681 - DNA, 2400 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000619617
  CDS Start-End: 3-578
ccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaagggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacagctgacaggttgtggggagtttggctggtgactgaatctggaaaggacccagagtgatgtgttgaaggacgggctgaaggcatgagggagaccccatggggaggctctgacatgggaggaggagcccttgaccacgttcacctggaaggggaggactcaggaaggcatcggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagccgctcctacgggggccagtacaggtgctatggtgcacacaacctctcctccgagtggtcggcccccagtgaccccctggacatcctgatcacaggacagatctatgacaccgtctccctgtcagcacagccgggccccacagtggcctcaggagagaacgtgaccctgctgtgtcagtcacgggggtattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgctgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaaaacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaa

SEQ ID NO: 148682 - DNA, 2403 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000616493
  CDS Start-End: 3-578
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccgactggataaagagggaagcccagagcccttggacagaaataacccactggaacccaagaacaaggccagattctccatcccatccatgacagagcaccatgcggggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgaaccccagccacagctgacaggttgtggggagtttggctggtgactgaatctggaaaggacccagagtgatgtgttgaaggacgggctgaaggcatgagggagaccccatggggaggctctgacatgggaggaggagccctcgaccacgttcacctggaaggggaggactcaggaaggcatcggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataacaaaaaaacaaaaaacaaaaacagacgtaaaggccgggtgtggtactcaggaggctgagtggggaggattccttgaacacaagaagttaaggctgctgaggctgcagtgagctatgactgtgccactgcactccagcctgtgtgacagagcgagaccttgtctctaaaaaaaaaaacagtgaatgttttaaa

SEQ ID NO: 148683 - DNA, 2170 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000619769
  CDS Start-End: 50-1945
ctgagggctcatccctctgcagagcgccgggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcacgggggtattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgctgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaat

SEQ ID NO: 148684 - DNA, 1976 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000616782
  CDS Start-End: 32-1399
gcagagcgcggggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagccaggaggcccaggagtaccgactgcataaagagggaagcccagagcccttggacagaaataacccactggaacccaagaacaaggccagattctccatcccatccatgacagagcaccatgcagggagataccgctgccactattacagctctgcaggctggtcagagcccagcgaccccctggagatggtgatgacaggagcctacagcaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtcgggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacaacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggtgagggcgctgaccccgtcctctctgagctcaaaggctcagctcaggcccaggcccccaggagagctctcggctgggatggaccgagggaggctgtgagggaggcttagccagagggcacccagccctcagaggggaggaggccaacaggggttctcctaggcgtggccacccgttctcccctgcctggcatgcagaaggcaccaggtgggcagagagatggttccagggaatccactgggcggaagcaggagagtgggagtggaagggtgcactccatggacggcccccgcccctcacccgcctcccgtgctccttccaggacactctggaggctccagcctcccacccacagggccgccctccacacctggtgagtcactgaggcctcgtggggagcgccgcctcccccagggcagtctgagtctcccaaaggatcccactcccctcccctcaaggacgggcttgtgtcccaggggctctgaggctgggctggtgaagagtggggggtcgaggcagagggagatgttggggcccagccaggaggaggagccgggctgatgtggggggcaagacagccccagccttcacctccctgtcctgacccaggaggtcctgaggaccagccccttaaccccccagggtcaggccctcagaatcgtgagtgaggggctctgagtgggagat

SEQ ID NO: 148685 - DNA, 1924 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000611863
  CDS Start-End: 3-584
ccatgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaagggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagccgctcctacgggggccagtacaggtgctatggtgcacacaacctctcctccgagtggtcggcccccagtgaccccctggacatcctgatcacaggacagatctatgacaccgtctccctgtcagcacagccgggccccacagtggcctcaggagagaacgtgaccctgctgtgtcagtcacgggggtattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148686 - DNA, 2204 bp, Homo sapiens
  Payload ID: 9418
  Gene Symbol: LILRB3
  Gene Name: leukocyte immunoglobulin-like receptor, subfamily B (with TM and ITIM domains), member 3
  Uniprot ID: O75022
  ENST ID: ENST00000611086
  CDS Start-End: 81-1976
acaccctgtgtgtctctctgtcctgccagcactgagggctcatccctctgcagagcgcggggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagccaggaggcccaggagtaccgactgcataaagagggaagcccagagcccttggacagaaataacccactggaacccaagaacaaggccagattctccatcccatccatgacagagcaccatgcagggagataccgctgccactattacagctctgcaggctggtcagagcccagcgaccccctggagatggtgatgacaggagcctacagcaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtcgggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacaacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaataac

SEQ ID NO: 148687 - DNA, 1924 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000613710
  CDS Start-End: 3-584
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagccaggaggcccaggagtaccgactgcataaagagggaagcccagagcccttggacagaaataacccactggaacccaagaacaaggccagattctccatcccatccatgacagagcaccatgcagggagataccgctgccactattacagctctgcaggctggtcagagcccagcgaccccctggagatggtgatgacaggagcctacagcaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtcgggggttccaggccctgttccctgtgggccccgtgacccccagccacaggcgtgtctaggaagccctccctcctgaccctgcagggccctgtcctggcccctgggcagagcctgaccctccagtgtggctctgatgtcggctacaacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148688 - DNA, 2154 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000622504
  CDS Start-End: 3-1472
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccgactggataaagagggaagcccagagcccttggacagaaataacccactggaacccaagaacaaggccagattctccatcccatccatgacagagcaccatgcggggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccaggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgggctgagactctgtccatcttcacccagaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatgactaatatcgtcccattttggaaataaagcaacagacttctcaacaatcaatgagttaat

SEQ ID NO: 148689 - DNA, 2066 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000620468
  CDS Start-End: 3-1901
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccccgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacaacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148690 - DNA, 2114 bp, Homo sapiens
  Payload ID: 9418
  Gene Symbol: LILRB3
  Gene Name: leukocyte immunoglobulin-like receptor, subfamily B (with TM and ITIM domains), member 3
  ENST ID: ENST00000622614
  CDS Start-End: 3-1949
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagcccttggacagaaataacccactggaacccaagaacaaggccagattctccatcccatccatgacacagcaccatgcagggagataccgctgccactattacagctctgcaggctggtcagagcccagcgaccccctggagctggtgatgacaggagcctacagcaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtcgggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacaacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctggagctcgtggtctcaggacactctggaggctccagcctcccacccacagggccgccctccacacctggaggtcctgaggaccagccccttaaccccccagggtcaggccctcagaatcgtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 148691 - DNA, 1896 bp, Homo sapiens
  Payload ID: 9418
  Gene Symbol: LILRB3
  Gene Name: leukocyte immunoglobulin-like receptor, subfamily B (with TM and ITIM domains), member 3
  Uniprot ID: O75022
  ENST ID: ENST00000621210
  CDS Start-End: 1-1896
atgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccgactggataaagagggaagcccagagcccttggacagaaataacccactggaacccaagaacaaggccagattctccatcccatccatgacagagcaccatgcggggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccaggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctcccacgggggccagtacaggtgctatggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgccgtgaaggacacacagtctgaggacagggtggagctggacagtcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactag

SEQ ID NO: 148692 - DNA, 539 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000270452
  CDS Start-End: 145-539
tgcagcatggacctgcaactttcctgaagcatctccagggctggatgccatgagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagagga

SEQ ID NO: 148693 - DNA, 1742 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000391733
  CDS Start-End: 15-1364
tgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacacttttcttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctcaggtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccggctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaa

SEQ ID NO: 148694 - DNA, 1602 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000391734
  CDS Start-End: 37-1224
ccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacacttttcttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcgggctgctgcatctgaagccccccaggatgtgacctacgcccggctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaa

SEQ ID NO: 148695 - DNA, 4002 bp, Homo sapiens
  Payload ID: 9419
  Gene Symbol: LILRB4
  Gene Name: leukocyte immunoglobulin-like receptor, subfamily B (with TM and ITIM domains), member 4
  Uniprot ID: Q8NHJ6
  ENST ID: ENST00000391736
  CDS Start-End: 316-1662
ggcctgtgggaggcagaatagtgacctcccagagatgtccacctcctgaggcccagaccctcccagggagacccattttggacttgtgacctccgggacgagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacacttttcttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccggctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaatgatacatgaatcttggccacaatgagaaaaataaaaatgaaaaaagagcaggcatccatttccatacaggaacaaaataggaggcagcactacagaccctacacacagctttacagaggtgaaagaaaactgtcagcaattctatgctgacataacagaaaatgtagatgagatagatgaaatacgaaaaattacagtttacttaatgaacataaggataaatagaaaaactgaatcatcatacataaacatatataaaatgcattgatcctgtaatcaaaaatgttcccacaaagtaaatgccacttcagcaaggtttgttggtggttttttcaaactcttatgcactcatgaaacacacagacacacacacacacaaacttgcataaattttccctgagaatattttgtatatatttacacaaatacatttgatcagactaggaacaagttgataccaaaacctgaaaaggaaactacagaatgggaaagtcatagaagatctctcacagaaatataaatcccttaacaaatattaacaagtaagattcatgtctctataaaatagacagtatatcatgaccacactggttttttgttatcctttgattttgtttatgaaaagcaaggatagcttaattttcaaaaactcaatcaatgtaattcagtattttaacaaaaggaatgaaaaattatcatctcaatagacaaagcttttgtctgagcaccttttcatatagctgctgaccatttgtatgtcttcttttgagaaatgcctgttcagctactttgcccatgtttcaagtagtttttggtttcttgctgttgctttgttttagttccttacatatttttgcatattaaccctttatcaggtatacagcttgcaactattttctcccatttctgagttgtctcttcattctgtttgcagaagctgtttagaagccacaccttttgtctatttttgcttttgttgcttgtgttttcagggccatatccaaaaaaaccttgcccggaccaacgtcttgaagcttttctcccacccatttttgtatatgggataagggttcaatttcattcttcttcatatgaatatccccaggatgtgtcctatgcccagctgcacagcttaccctcaaacagaaaataatgaagccttcttcctcccaggaaaggggacgttcagctgagccgagtgtgtatactgctctggccatccactagcccagggaggacccagacctccacactccatggagactcagttctcctaggaccatttattcaaaaggactgccctctcttgttcttggaaactttgttgaggatcaattcaccataaatatgtgtgtttccttctttgctttcatccctgttgcactgatcactgtacctgtttctattccagttccatgatgtcttcctggctgtagctttgtaggatatttggggattccatagtgtgatatccccttcttccctttgctcaagattgttttggctatttggggtccttttgtagtcccattcaaattttaggattgtttttctatttctgtggaaaacgaccttggaattttgttaggaattgcattgagtctgcaggtatgaacttttttttaaagttccagggcacatgtacaggacctgcagctttgttacataggtaggcttgtgccatggtggtttgctgcacctatcaacccattacctagttattaagcccagcatgcattagctctttttcctgatgctctccctcccttcatcatccgccctcccactacaagccccagtgtgtgttgttcccctccctgtgtccatgtgttctcattgttatacgaacattttaacaatgttaattcttgcagaccatgaacataagctaccttcccatttatatgcgtcttgttcaatttcattcatcaatgttataaagattttagtgcaga

SEQ ID NO: 148696 - DNA, 1204 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000434286
  CDS Start-End: 8-1204
agacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacacttttcttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgag

SEQ ID NO: 148697 - DNA, 1761 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000430952
  CDS Start-End: 40-1383
catccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacacttttcttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccggctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaa

SEQ ID NO: 148698 - DNA, 4002 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000616137
  CDS Start-End: 316-1662
ggcctgtgggaggcagaatagtgacctcccagagatgtccacctcctgaggcccagaccctcccagggagacccattttggacttgtgacctccgggacgagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaaggacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaatgatacatgaatcttggccacaatgagaaaaataaaaatgaaaaaagagcaggcatccatttccatacaggaacaaaataggaggcagcactacagaccctacacacagctttacagaggtgaaagaaaactgtcagcaattctatgctgacataacagaaaatgtagatgagatagatgaaatacgaaaaattacagtttacttaatgaacataaggataaatagaaaaactgaatcatcatacataaacatatataaaatgcattgatcctgtaatcaaaaatgttcccacaaagtaaatgccacttcagcaaggtttgttggtggttttttcaaactcttatgcactcatgaaacacacagacacacacacacacaaacttgcataaattttccctgagaatattttgtatatatttacacaaatacatttgatcagactaggaacaagttgataccaaaacctgaaaaggaaactacagaatgggaaagtcatagaagatctctcacagaaatataaatcccttaacaaatattaacaagtaagattcatgtctctataaaatagacagtatatcatgaccacactggttttttgttatcctttgattttgtttatgaaaagcaaggatagcttaattttcaaaaactcaatcaatgtaattcagtattttaacaaaaggaatgaaaaattatcatctcaatagacaaagcttttgtctgagcaccttttcatatagctgctgaccatttgtatgtcttcttttgagaaatgcctgttcagctactttgcccatgtttcaagtagtttttggtttcttgctgttgctttgttttagttccttacatatttttgcatattaaccctttatcaggtatacagcttgcaactattttctcccatttctgagttgtctcttcattctgtttgcagaagctgtttagaagccacaccttttgtctatttttgcttttgttgcttgtgttttcagggccatatccaaaaaaaccttgcccggaccaacgtcttgaagcttttctcccacccatttttgtatatgggataagggttcaatttcattcttcttcatatgaatatccccaggatgtgtcctatgcccagctgcacagcttaccctcaaacagaaaataatgaagccttcttcctcccaggaaaggggacgttcagctgagccgagtgtgtatactgctctggccatccactagcccagggaggacccagacctccacactccatggagactcagttctcctaggaccatttattcaaaaggactgccctctcttgttcttggaaactttgttgaggatcaattcaccataaatatgtgtgtttccttctttgctttcatccctgttgcactgatcactgtacctgtttctattccagttccatgatgtcttcctggctgtagctttgtaggatatttggggattccatagtgtgatatccccttcttccctttgctcaagattgttttggctatttggggtccttttgtagtcccattcaaattttaggattgtttttctatttctgtggaaaacgaccttggaattttgttaggaattgcattgagtctgcaggtatgaacttttttttaaagttccagggcacatgtacaggacctgcagctttgttacataggtaggcttgtgccatggtggtttgctgcacctatcaacccattacctagttattaagcccagcatgcattagctctttttcctgatgctctccctcccttcatcatccgccctcccactacaagccccagtgtgtgttgttcccctccctgtgtccatgtgttctcattgttatacgaacattttaacaatgttaattcttgcagaccatgaacataagctaccttcccatttatatgcgtcttgttcaatttcattcatcaatgttataaagattttagtgcaga

SEQ ID NO: 148699 - DNA, 1377 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000621368
  CDS Start-End: 64-1377
tttgtcctgccggcactgaggactcatccatctgcacagctggggcccctgggaggagacgccatgatccccaccctcacggctctgctctgcctcgggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacacttttcttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctcaggtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccggctgcacagctttaccctcagacagaaggcaactgagcctcctccatcccaggaaggggcctctccagctgagcccagtgtctatgccactctggccatccactaa

SEQ ID NO: 148700 - DNA, 1204 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000621149
  CDS Start-End: 8-1204
agacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggaggatcccaggccctcacccacaaggtccgtctcaacagctggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgag

SEQ ID NO: 148701 - DNA, 1742 bp, Homo sapiens
  Payload ID: 9419
  Gene Symbol: LILRB4
  Gene Name: leukocyte immunoglobulin-like receptor, subfamily B (with TM and ITIM domains), member 4
  Uniprot ID: Q8NHJ6
  ENST ID: ENST00000614699
  CDS Start-End: 15-1364
tgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggaggatcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctcaggtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaa

SEQ ID NO: 148702 - DNA, 1588 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000621985
  CDS Start-End: 40-1383
catccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaaggacacacagcctgaggacggggtggaaatggacactcggagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctc

SEQ ID NO: 148703 - DNA, 1811 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000620735
  CDS Start-End: 80-1426
acaccctgtgtgtctctttgtcctgccggcactgaggactcatccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctcaggtgctgccgtgaaggacacacagcctgaggacggggtggaaatggacactcggagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaat

SEQ ID NO: 148704 - DNA, 1540 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000622693
  CDS Start-End: 15-1364
tgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctcaggtgctgccgtgaaggacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccggctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctg

SEQ ID NO: 148705 - DNA, 3718 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000613131
  CDS Start-End: 35-1381
atctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaaggacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaatgatacatgaatcttggccacaatgagaaaaataaaaatgaaaaaagagcaggcatccatttccatacaggaacaaaataggaggcagcactacagaccctacacacagctttacagaggtgaaagaaaactgtcagcaattctatgctgacataacagaaaatgtagatgagatagatgaaatacgaaaaattacagtttacttaatgaacataaggataaatagaaaaactgaatcatcatacataaacatatataaaatgcattgatcctgtaatcaaaaatgttcccacaaagtaaatgccacttcagcaaggtttgttggtggttttttcaaactcttatgcactcatgaaacacacagacacacacacacacaaacttgcataaattttccctgagaatattttgtatatatttacacaaatacatttgatcagactaggaacaagttgataccaaaacctgaaaaggaaactacagaatgggaaagtcatagaagatctctcacagaaatataaatcccttaacaaatattaacaagtaagattcatgtctctataaaatagacagtatatcatgaccacactggttttttgttatcctttgattttgtttatgaaaagcaaggatagcttaattttcaaaaactcaatcaatgtaattcagtattttaacaaaaggaatgaaaaattatcatctcaatagacaaagcttttgtctgagcaccttttcatatagctgctgaccatttgtatgtcttcttttgagaaatgcctgttcagctactttgcccatgtttcaagtagtttttggtttcttgctgttgctttgttttagttccttacatatttttgcatattaaccctttatcaggtatacagcttgcaactattttctcccatttctgagttgtctcttcattctgtttgcagaagctgtttagaagccacaccttttgtctatttttgcttttgttgcttgtgttttcagggccatatccaaaaaaaccttgcccggaccaacgtcttgaagcttttctcccacccatttttgtatatgggataagggttcaatttcattcttcttcatatgaatatccccaggatgtgtcctatgcccagctgcacagcttaccctcaaacagaaaataatgaagccttcttcctcccaggaaaggggacgttcagctgagccgagtgtgtatactgctctggccatccactagcccagggaggacccagacctccacactccatggagactcagttctcctaggaccatttattcaaaaggactgccctctcttgttcttggaaactttgttgaggatcaattcaccataaatatgtgtgtttccttctttgctttcatccctgttgcactgatcactgtacctgtttctattccagttccatgatgtcttcctggctgtagctttgtaggatatttggggattccatagtgtgatatccccttcttccctttgctcaagattgttttggctatttggggtccttttgtagtcccattcaaattttaggattgtttttctatttctgtggaaaacgaccttggaattttgttaggaattgcattgagtctgcaggtatgaacttttttttaaagttccagggcacatgtacaggacctgcagctttgttacataggtaggcttgtgccatggtggtttgctgcacctatcaacccattacctagttattaagcccagcatgcattagctctttttcctgatgctctccctcccttcatcatccgccctcccactacaagccccagtgtgtgttgttcccctccctgtgtccatgtgttctcattgttatacgaacattttaacaatgttaattcttgcagaccatgaacataagctaccttcccatttatatgcgtcttgttcaatttcattcatcaatgttataaagattttagtgc

SEQ ID NO: 148706 - DNA, 3902 bp, Homo sapiens
  Payload ID: 9419
  Gene Symbol: LILRB4
  Gene Name: leukocyte immunoglobulin-like receptor, subfamily B (with TM and ITIM domains), member 4
  Uniprot ID: Q8NHJ6
  ENST ID: ENST00000612454
  CDS Start-End: 216-1562
agaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggaggatcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaatgatacatgaatcttggccacaatgagaaaaataaaaatgaaaaaagagcaggcatccatttccatacaggaacaaaataggaggcagcactacagaccctacacacagctttacagaggtgaaagaaaactgtcagcaattctatgctgacataacagaaaatgtagatgagatagatgaaatacgaaaaattacagtttacttaatgaacataaggataaatagaaaaactgaatcatcatacataaacatatataaaatgcattgatcctgtaatcaaaaatgttcccacaaagtaaatgccacttcagcaaggtttgttggtggttttttcaaactcttatgcactcatgaaacacacagacacacacacacacaaacttgcataaattttccctgagaatattttgtatatatttacacaaatacatttgatcagactaggaacaagttgataccaaaacctgaaaaggaaactacagaatgggaaagtcatagaagatctctcacagaaatataaatcccttaacaaatattaacaagtaagattcatgtctctataaaatagacagtatatcatgaccacactggttttttgttatcctttgattttgtttatgaaaagcaaggatagcttaattttcaaaaactcaatcaatgtaattcagtattttaacaaaaggaatgaaaaattatcatctcaatagacaaagcttttgtctgagcaccttttcatatagctgctgaccatttgtatgtcttcttttgagaaatgcctgttcagctactttgcccatgtttcaagtagtttttggtttcttgctgttgctttgttttagttccttacatatttttgcatattaaccctttatcaggtatacagcttgcaactattttctcccatttctgagttgtctcttcattctgtttgcagaagctgtttagaagccacaccttttgtctatttttgcttttgttgcttgtgttttcagggccatatccaaaaaaaccttgcccggaccaacgtcttgaagcttttctcccacccatttttgtatatgggataagggttcaatttcattcttcttcatatgaatatccccaggatgtgtcctatgcccagctgcacagcttaccctcaaacagaaaataatgaagccttcttcctcccaggaaaggggacgttcagctgagccgagtgtgtatactgctctggccatccactagcccagggaggacccagacctccacactccatggagactcagttctcctaggaccatttattcaaaaggactgccctctcttgttcttggaaactttgttgaggatcaattcaccataaatatgtgtgtttccttctttgctttcatccctgttgcactgatcactgtacctgtttctattccagttccatgatgtcttcctggctgtagctttgtaggatatttggggattccatagtgtgatatccccttcttccctttgctcaagattgttttggctatttggggtccttttgtagtcccattcaaattttaggattgtttttctatttctgtggaaaacgaccttggaattttgttaggaattgcattgagtctgcaggtatgaacttttttttaaagttccagggcacatgtacaggacctgcagctttgttacataggtaggcttgtgccatggtggtttgctgcacctatcaacccattacctagttattaagcccagcatgcattagctctttttcctgatgctctccctcccttcatcatccgccctcccactacaagccccagtgtgtgttgttcccctccctgtgtccatgtgttctcattgttatacgaacattttaacaatgttaattcttgcagaccatgaacataagctaccttcccatttatatgcgtcttgttcaatttcattcatcaatgttataaagattttagtgcaga

SEQ ID NO: 148707 - DNA, 1202 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000611165
  CDS Start-End: 361-1202
agaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggaggatcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggagcccacacgatgaagacccccaggcagtgacgtatgccaaggtgaaacactccagacctag

SEQ ID NO: 148708 - DNA, 1811 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000618480
  CDS Start-End: 80-1426
acaccctgtgtgtctctttgtcctgccggcactgaggactcatccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctcaggtgctgccgtgaaggacacacagcctgaggacggggtggaaatggacactcggagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccggctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaat

SEQ ID NO: 148709 - DNA, 3869 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000619525
  CDS Start-End: 93-1529
agaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcgggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggaggatcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctcaggtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaatgatacatgaatcttggccacaatgagaaaaataaaaatgaaaaaagagcaggcatccatttccatacaggaacaaaataggaggcagcactacagaccctacacacagctttacagaggtgaaagaaaactgtcagcaattctatgctgacataacagaaaatgtagatgagatagatgaaatacgaaaaattacagtttacttaatgaacataaggataaatagaaaaactgaatcatcatacataaacatatataaaatgcattgatcctgtaatcaaaaatgttcccacaaagtaaatgccacttcagcaaggtttgttggtggttttttcaaactcttatgcactcatgaaacacacagacacacacacacacaaacttgcataaattttccctgagaatattttgtatatatttacacaaatacatttgatcagactaggaacaagttgataccaaaacctgaaaaggaaactacagaatgggaaagtcatagaagatctctcacagaaatataaatcccttaacaaatattaacaagtaagattcatgtctctataaaatagacagtatatcatgaccacactggttttttgttatcctttgattttgtttatgaaaagcaaggatagcttaattttcaaaaactcaatcaatgtaattcagtattttaacaaaaggaatgaaaaattatcatctcaatagacaaagcttttgtctgagcaccttttcatatagctgctgaccatttgtatgtcttcttttgagaaatgcctgttcagctactttgcccatgtttcaagtagtttttggtttcttgctgttgctttgttttagttccttacatatttttgcatattaaccctttatcaggtatacagcttgcaactattttctcccatttctgagttgtctcttcattctgtttgcagaagctgtttagaagccacaccttttgtctatttttgcttttgttgcttgtgttttcagggccatatccaaaaaaaccttgcccggaccaacgtcttgaagcttttctcccacccatttttgtatatgggataagggttcaatttcattcttcttcatatgaatatccccaggatgtgtcctatgcccagctgcacagcttaccctcaaacagaaaataatgaagccttcttcctcccaggaaaggggacgttcagctgagccgagtgtgtatactgctctggccatccactagcccagggaggacccagacctccacactccatggagactcagttctcctaggaccatttattcaaaaggactgccctctcttgttcttggaaactttgttgaggatcaattcaccataaatatgtgtgtttccttctttgctttcatccctgttgcactgatcactgtacctgtttctattccagttccatgatgtcttcctggctgtagctttgtaggatatttggggattccatagtgtgatatccccttcttccctttgctcaagattgttttggctatttggggtccttttgtagtcccattcaaattttaggattgtttttctatttctgtggaaaacgaccttggaattttgttaggaattgcattgagtctgcaggtatgaacttttttttaaagttccagggcacatgtacaggacctgcagctttgttacataggtaggcttgtgccatggtggtttgctgcacctatcaacccattacctagttattaagcccagcatgcattagctctttttcctgatgctctccctcccttcatcatccgccctcccactacaagccccagtgtgtgttgttcccctccctgtgtccatgtgttctcattgttatacgaacattttaacaatgttaattcttgcagaccatgaacataagctaccttcccatttatatgcgtcttgttcaatttcattcatcaatgttataaagattttagtgcaga

SEQ ID NO: 148710 - DNA, 1761 bp, Homo sapiens
  Payload ID: 9419
  Gene Symbol: LILRB4
  Gene Name: leukocyte immunoglobulin-like receptor, subfamily B (with TM and ITIM domains), member 4
  Uniprot ID: Q8NHJ6
  ENST ID: ENST00000621693
  CDS Start-End: 40-1383
catccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggaggatcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaa

SEQ ID NO: 148711 - DNA, 3098 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000617098
  CDS Start-End: 35-1381
atctgcacagctggggcccctgggaggagacgccatgatccccaccctcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacacttttcttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccggctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaatgatacatgaatcttggccacaatgagaaaaataaaaatgaaaaaagagcaggcatccatttccatacaggaacaaaataggaggcagcactacagaccctacacacagctttacagaggtgaaagaaaactgtcagcaattctatgctgacataacagaaaatgtagatgagatagatgaaatacgaaaaattacagtttacttaatgaacataaggataaatagaaaaactgaatcatcatacataaacatatataaaatgcattgatcctgtaatcaaaaatgttcccacaaagtaaatgccacttcagcaaggtttgttggtggttttttcaaactgttatgcactcatgaaacacacagacacacacacacacaaacttgcataaattttccctgagaatattttgtatatatttacacaaatacatttgatcagactaggaacaagttgataccaaaacctgaaaaggaaactacagaatgggaaagtcatagaagatctctcacagaaatataaatcccttaacaaatattaacaagtaagattcatgtctctataaaatagacagtatatcatgaccacactggttttttgttatcctttgattttgtttatgaaaagcaaggatagcttaattttcaaaaactcaatcaatgtaattcagtattttaacaaaaggaatgaaaaattatcatctcaatagacaaagcttttgtctgagcaccttttcatatagctgctgaccatttgtatgtcttcttttgagaaatgcctgttcagctactttgcccatgtttcaagtagtttttggtttcttgctgttgctttgttttagttccttacatatttttgcatattaaccctttatcaggtatacagcttgcaactattttctcccatttctgagttgtctcttcattctgtttgcagaagctgtttagaagccacaccttttgtctatttttgcttttgttgcttgtgttttcagggccatatccaaaaaaaccttgcccggaccaacgtcttgaagcttttctcccacccatttttgtatatgggataagggttcaatttcattcttcttcatatgaatatccccaggatgtgtcctatgcccagctgcacagcttaccctcaaacagaaaataatgaagccttcttcctcccaggaaaggggacgttcagctgagccgagtgtgtatactgctctggccatccactagcccagggaggacccagacctccacactccatggagactcagttctcctaggaccatttattcaaaaggactgccctctcttgttcttggaaactttgttgaggat

SEQ ID NO: 148712 - DNA, 1588 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000619910
  CDS Start-End: 40-1383
catccatctgcacagctggggcccctgggaggagacgccatgatccccaccctcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacacttttcttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccggctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctc

SEQ ID NO: 148713 - DNA, 1602 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000613090
  CDS Start-End: 37-1224
ccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggaggatcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcgggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaa

SEQ ID NO: 148714 - DNA, 1272 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000494796
  CDS Start-End: 163-354
agagatgtccacctcctgaggcccagaccctcccagggagacccattttggacttgtgacctccgggacgagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacacttttcttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggagcccacacgatgaagacccccaggcagtgacgtatgccaaggtgaaacactccagacctag

SEQ ID NO: 148715 - DNA, 1588 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000621555
  CDS Start-End: 40-1383
catccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaaggacacacagcctgaggacggggtggaaatggacactcggagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccggctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctc

SEQ ID NO: 148716 - DNA, 820 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000614214
  CDS Start-End: 316-820
ggcctgtgggaggcagaatagtgacctcccagagatgtccacctcctgaggcccagaccctcccagggagacccattttggacttgtgacctccgggacgagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccctcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacacttttcttctgatcaaggagcgggcagcccatcccctactgcatctgagat

SEQ ID NO: 148717 - DNA, 1540 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000614340
  CDS Start-End: 15-1364
tgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctcaggtgctgccgtgaaggacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctg

SEQ ID NO: 148718 - DNA, 430 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000618034
  CDS Start-End: 1-76
agagcccaaggacgggggcctacagaggaggtccagcccagctgctgacgtccagggagaaaacttctgtgagtgagaggcagagaaggtgctgccgtgaagaacacacagcctgaggacggggtggaaatggacactcgggtgagaacccgcccctgtccccggcaccaaaggcctcctggtgccagatctaatcctgcaggacttctctgtcctccttcccccggctctcagcatcgtcacggtggacccctccttgtccagcacgctgcctcctgcctgctgggacctcactctctcctgctgtcctgggacctcatgggcctcctcccgggtccccttcctgctcctcatcctctgtttggccatctggttgttagagagctccccaggcctcaggaggatgacgaataaatgaaccactccagtc

SEQ ID NO: 148719 - DNA, 1540 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000616806
  CDS Start-End: 15-1364
tgggaggagacgccatgatccccaccctcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacacttttcttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctcaggtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccggctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctg

SEQ ID NO: 148720 - DNA, 4002 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000615614
  CDS Start-End: 316-1662
ggcctgtgggaggcagaatagtgacctcccagagatgtccacctcctgaggcccagaccctcccagggagacccattttggacttgtgacctccgggacgagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaaggacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccggctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaatgatacatgaatcttggccacaatgagaaaaataaaaatgaaaaaagagcaggcatccatttccatacaggaacaaaataggaggcagcactacagaccctacacacagctttacagaggtgaaagaaaactgtcagcaattctatgctgacataacagaaaatgtagatgagatagatgaaatacgaaaaattacagtttacttaatgaacataaggataaatagaaaaactgaatcatcatacataaacatatataaaatgcattgatcctgtaatcaaaaatgttcccacaaagtaaatgccacttcagcaaggtttgttggtggttttttcaaactcttatgcactcatgaaacacacagacacacacacacacaaacttgcataaattttccctgagaatattttgtatatatttacacaaatacatttgatcagactaggaacaagttgataccaaaacctgaaaaggaaactacagaatgggaaagtcatagaagatctctcacagaaatataaatcccttaacaaatattaacaagtaagattcatgtctctataaaatagacagtatatcatgaccacactggttttttgttatcctttgattttgtttatgaaaagcaaggatagcttaattttcaaaaactcaatcaatgtaattcagtattttaacaaaaggaatgaaaaattatcatctcaatagacaaagcttttgtctgagcaccttttcatatagctgctgaccatttgtatgtcttcttttgagaaatgcctgttcagctactttgcccatgtttcaagtagtttttggtttcttgctgttgctttgttttagttccttacatatttttgcatattaaccctttatcaggtatacagcttgcaactattttctcccatttctgagttgtctcttcattctgtttgcagaagctgtttagaagccacaccttttgtctatttttgcttttgttgcttgtgttttcagggccatatccaaaaaaaccttgcccggaccaacgtcttgaagcttttctcccacccatttttgtatatgggataagggttcaatttcattcttcttcatatgaatatccccaggatgtgtcctatgcccagctgcacagcttaccctcaaacagaaaataatgaagccttcttcctcccaggaaaggggacgttcagctgagccgagtgtgtatactgctctggccatccactagcccagggaggacccagacctccacactccatggagactcagttctcctaggaccatttattcaaaaggactgccctctcttgttcttggaaactttgttgaggatcaattcaccataaatatgtgtgtttccttctttgctttcatccctgttgcactgatcactgtacctgtttctattccagttccatgatgtcttcctggctgtagctttgtaggatatttggggattccatagtgtgatatccccttcttccctttgctcaagattgttttggccatttggggtccttttgtagtcccattcaaattttaggattgtttttctatttctgtggaaaacgaccttggaattttgttaggaattgcattgagtctgcaggtatgaacttttttttaaagttccagggcacatgtacaggacctgcagctttgttacataggtaggcttgtgccatggtggtttgctgcacctatcaacccattacctagttattaagcccagcatgcattagctctttttcctgatgctctccctcccttcatcatccgccctcccactacaagccccagtgtgtgttgttcccctccctgtgtccatgtgttctcattgttatacgaacattttaacaatgttaattcttgcagaccatgaacataagctaccttcccatttatatgcgtcttgttcaatttcattcatcaatgttataaagattttagtgcaga

SEQ ID NO: 148721 - DNA, 1811 bp, Homo sapiens
  Payload ID: 9419
  Gene Symbol: LILRB4
  Gene Name: leukocyte immunoglobulin-like receptor, subfamily B (with TM and ITIM domains), member 4
  ENST ID: ENST00000617426
  CDS Start-End: 80-1426
acaccctgtgtgtctctttgtcctgccggcactgaggactcatccatctgcacagctggggcccctgggaggagacgccatgatccccaccctcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacacttttcttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctcaggtgctgccgtgaagaacacacagcctgaggacggggtggaaatggacactcggagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccggctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaat

SEQ ID NO: 148722 - DNA, 1864 bp, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENST ID: ENST00000345866
  CDS Start-End: 70-1545
gtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctccggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactac

SEQ ID NO: 148723 - DNA, 3236 bp, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENST ID: ENST00000316219
  CDS Start-End: 109-1881
gtgacagggagaacccagcctccagtccacactctgcgtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctccggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactacaaatgagcgaatgaattagaaaagaataaaacctacgtaattaatgaccttggcaatgacagaaagaatttagaaaaagaacaacaaattattccaaatgaaggtgtgaggaaggggacaaaaataacaagaggagttactaatgagggctacgtgaaaactcgatgaagccaaaaaagctcattcttgagaatgtgaattacattcacaaatcctagccacaataagcaaggaaaaaagcggggttcaggcacacatttccatatgggggtgaaacagcagacaccaccacaaatctgacacatattgcctttatttttttcacttttaagttcagggatacatgtgcaggtttgttagacagataaacttgtgtcaaggggatttgtcttggtttttgtgtgagggtttttgttttgttttgttttgttttttgagacggagtctcgctctatcaccaggctggagtacagtggagtgatctcggctcactgcaacctctgcctcccgggttcaagcgattctcctgcctcagtctcccgagtaactgggactacaggcacctgccaccacgcccggctaatttttgtatttttagtagagacagggtttctccatgttggtcaggctggtctcaaactcccgacctcaggtgatccgcccgcctcagcctcccaaagtgctgggcttacaggcgtgagccaccacgtccagcccatacatttcaattttaaagggatgcgccctagtccttagttagtctctcctcatctctataaaatgttcagctactcacctcttgggctattgctagacatcgttttctcttccttctttctgacgcctacaatagataggacattccccctcctcattctattctcccaagtactttaaattgcaatttataaagtttctatgctacactctaaaaaaaattctgttttgttttctaatttcataattggtgcttcactgtgtcttgtcctcgaaggaatgagtattttgattgtgttcattaaatctgatttttcta

SEQ ID NO: 148724 - DNA, 2137 bp, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENST ID: ENST00000449561
  CDS Start-End: 72-1847
gtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctccggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatatta

SEQ ID NO: 148725 - DNA, 2204 bp, Homo sapiens
  Payload ID: 9420
  Gene Symbol: LILRB5
  Gene Name: leukocyte immunoglobulin-like receptor, subfamily B (with TM and ITIM domains), member 5
  ENST ID: ENST00000614807
  CDS Start-End: 70-2001
gtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcggcagagcccacacgatgaagacccccaggcagtgacgtatgccccggtgaaacactccagacctaggagagaaatggcctctcctccttccccactgtctggggaattcctggacacaaaggacagacaggcagaagaggacagacagatggacactgaggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagcc

SEQ ID NO: 148726 - DNA, 2211 bp, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENST ID: ENST00000615837
  CDS Start-End: 122-1894
atgggacagtcttgtgacagggagaacccagcctccagtccacactctgcgtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaact

SEQ ID NO: 148727 - DNA, 2137 bp, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENST ID: ENST00000616618
  CDS Start-End: 72-1847
gtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctacacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatatta

SEQ ID NO: 148728 - DNA, 1875 bp, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENST ID: ENST00000610764
  CDS Start-End: 81-1556
acactctgcgtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactac

SEQ ID NO: 148729 - DNA, 2137 bp, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENST ID: ENST00000619608
  CDS Start-End: 72-1847
gtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatatta

SEQ ID NO: 148730 - DNA, 660 bp, Homo sapiens
  Payload ID: 9420
  Gene Symbol: LILRB5
  Gene Name: leukocyte immunoglobulin-like receptor, subfamily B (with TM and ITIM domains), member 5
  ENST ID: ENST00000614645
  CDS Start-End: 185-660
aattgttctgaaaaccttgaacatggttggaggcacagagggacggccaaggacaaaggggcactgaggaggcaggaacgacttagaggttcattcccagcggaggggttttgttgctctgccctagcccttggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaaga

SEQ ID NO: 148731 - DNA, 2444 bp, Homo sapiens
  Payload ID: 9420
  Gene Symbol: LILRB5
  Gene Name: leukocyte immunoglobulin-like receptor, subfamily B (with TM and ITIM domains), member 5
  ENST ID: ENST00000620244
  CDS Start-End: 79-1947
actctgcgtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcggcagagcccacacgatgaagacccccaggcagtgacgtatgccgaggtgaaacactccagacctaggagagaaatggcctctcctccctccccactgtctggggaattcctggacacaaaggacagacaggcagaagaggacagacagatggacactgagagagtcctttcctctccaggcccccaggcctccccacccccaccacgttccttacctctcactctcccccgctgcaggctgctgcatctgaagccccccaggatgtgacctacgcccagctacacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactacaaatgagcgaatgaattagaaaagaataaaacctacgtaattaatgaccttggcaatgacag

SEQ ID NO: 148732 - DNA, 1864 bp, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENST ID: ENST00000620714
  CDS Start-End: 70-1545
gtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactac

SEQ ID NO: 148733 - DNA, 2137 bp, Homo sapiens; identical to SEQ ID NO: 148729
  Payload ID: 9420
  Gene Symbol: LILRB5
  Gene Name: leukocyte immunoglobulin-like receptor, subfamily B (with TM and ITIM domains), member 5
  Uniprot ID: O75023
  ENST ID: ENST00000621867
  CDS Start-End: 72-1847

SEQ ID NO: 148734 - DNA, 639 bp, Homo sapiens
  Payload ID: 9420
  Gene Symbol: LILRB5
  Gene Name: leukocyte immunoglobulin-like receptor, subfamily B (with TM and ITIM domains), member 5
  ENST ID: ENST00000622648
  CDS Start-End: 185-639
aattgttctgaaaaccttgaacatggttggaggcacagagggacggccaaggacaaaggggcactgaggaggcaggaacgacttagaggttcattcccagcggaggggttttgttgctctgccctagcccttggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcac

SEQ ID NO: 148735 - DNA, 2204 bp, Homo sapiens; identical to SEQ ID NO: 148725
  Payload ID: 9420
  Gene Symbol: LILRB5
  Gene Name: leukocyte immunoglobulin-like receptor, subfamily B (with TM and ITIM domains), member 5
  ENST ID: ENST00000610568
  CDS Start-End: 70-2001

SEQ ID NO: 148736 - DNA, 665 bp, Homo sapiens
  Payload ID: 9420
  Gene Symbol: LILRB5
  Gene Name: leukocyte immunoglobulin-like receptor, subfamily B (with TM and ITIM domains), member 5
  ENST ID: ENST00000618355
  CDS Start-End: 185-665
aattgttctgaaaaccttgaacatggttggaggcacagagggacggccaaggacaaaggggcactgaggaggcaggaacgacttagaggttcattcccagcggaggggttttgttgctctgccctagcccttggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacaga

SEQ ID NO: 148737 - DNA, 2189 bp, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENST ID: ENST00000621193
  CDS Start-End: 100-1872
agaacccagcctccagtccacactctgcgtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctacacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaact

SEQ ID NO: 148738 - DNA, 1872 bp, Homo sapiens
  Payload ID: 9420
  Gene Symbol: LILRB5
  Gene Name: leukocyte immunoglobulin-like receptor, subfamily B (with TM and ITIM domains), member 5
  ENST ID: ENST00000621221
  CDS Start-End: 81-1553
acactctgcgtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctacacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactac

SEQ ID NO: 148739 - DNA, 1964 bp, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENST ID: ENST00000615429
  CDS Start-End: 112-1587
cttgtgacagggagaacccagcctccagtccacactctgcgtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctacacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactacaaatgagcgaatgaattagaaaagaataaaacctacgtaattaatgaccttggcaatg

SEQ ID NO: 148740 - DNA, 1864 bp, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENST ID: ENST00000622596
  CDS Start-End: 70-1545
gtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctacacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactac

SEQ ID NO: 148741 - DNA, 2189 bp, Homo sapiens; identical to SEQ ID NO: 148737
  Payload ID: 9420
  Gene Symbol: LILRB5
  Gene Name: leukocyte immunoglobulin-like receptor, subfamily B (with TM and ITIM domains), member 5
  Uniprot ID: O75023
  ENST ID: ENST00000617355
  CDS Start-End: 100-1872

SEQ ID NO: 148742 - DNA, 2189 bp, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENST ID: ENST00000616805
  CDS Start-End: 100-1872
agaacccagcctccagtccacactctgcgtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaact

SEQ ID NO: 148743 - DNA, 2264 bp, Homo sapiens
  Payload ID: 9420
  Gene Symbol: LILRB5
  Gene Name: leukocyte immunoglobulin-like receptor, subfamily B (with TM and ITIM domains), member 5
  Uniprot ID: O75023
  ENST ID: ENST00000614318
  CDS Start-End: 112-1887
cttgtgacagggagaacccagcctccagtccacactctgcgtgtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctacacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactacaaatgagcgaatgaattagaaaagaataaaacctacgtaattaatgaccttggcaatg

SEQ ID NO: 148744 - DNA, 2318 bp, Homo sapiens
  Payload ID: 9420
  Gene Symbol: LILRB5
  Gene Name: leukocyte immunoglobulin-like receptor, subfamily B (with TM and ITIM domains), member 5
  ENST ID: ENST00000615267
  CDS Start-End: 70-2001
gtttttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcggcagagcccacacgatgaagacccccaggcagtgacgtatgccgaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccagctacacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaact

SEQ ID NO: 148745 - DNA, 1542 bp, Homo sapiens
  Payload ID: 9421
  Gene Symbol: LENG1
  Gene Name: leukocyte receptor cluster (LRC) member 1
  Uniprot ID: Q96BZ8
  ENST ID: ENST00000222224
  CDS Start-End: 188-982
aacgcctagcattcgctgtgataaagggcgtctcagccaatcacctgtcgctacaggccagggggccgtaccaactaattcggaaccaatccgcggtcgaagtagggacaagaaaaaggggggcatcctctcgccaatcggaagtgcaaagaggcgggcgtgccagtccctggacagctacgacgccatgaatatcttgcccaagaagagctggcacgtccggaacaaggacaatgtcgcccgcgtgcggcgtgacgaggcccaggcccgggaggaggagaaggagcgtgagcggagggtgctgctggctcagcaagaggcccgtacagaattcctacggaagaaagccagacatcagaactcactgcctgagcttgaagcagcagaggcgggagccccaggttctggccctgtggacctgtttcgggagctgctggaggaagggaaaggagtgatcagaggcaataaagagtacaaggaagaaaagcgacaggagaaagagaggcaagagaaagctctgggcatcctgacatacctgggccagagtgcagcggaggcacagactcaacccccttggtaccagctacccccagggcgagggggccccccgcccggcccagccccagatgagaagatcaagagccgtctggaccctctgcgggagatgcagaagcatctggggaagaagagacagcacggcggtgatgaaggcagtcgcagcagaaaggaaaaggaggggtctgagaagcagcgacccaaggagcctccatccctggaccagcttcgagctgaacgtctgcggagggaagcagctgagaggtctcgggcagaggccctgctggcccgggtccaaggccgggcactacaggagggtcagccggaagaagacgagacggatgaccggcggcggcggtacaactcccaattcaacccccagctggcccggcgcccccgccagcaggaccctcaccttactcactgactcctgagggggtacaggagaggccgctgctgccagccgtcatataaaactatttattcataaatattttccaaaatgaaaataggtttaccaaaaaatgtccctcactggggaggggaggagggggcagccctcgcccccgggcccccagggtggggctgagaggaaaacctcccggccccctccctgcttcctgggagagggggatgccccgtggcttggggcctccctccagtcttccagggcagggccctcacctgggcagggggatcagcatgcgggggaagggggtgggtagagggaggggccggtgtcactggaggtcccggtcctccaggtagcggtactcaaaggtgaagccttccttcttccgctggccccacttctcgtagtcaaagtagatgtaggtgccctggccgggggagaaggcggtcagtgagtggacgaggaggtggtctgggatctgggccggaccaacagacaaaggggacaattcttagggctgtggatgtgtcaggcaccgggccagctgccctgcacgcacacactctcatccatcc

SEQ ID NO: 148746 - DNA, 886 bp, Homo sapiens
  Payload ID: 9421
  Gene Symbol: LENG1
  Gene Name: leukocyte receptor cluster (LRC) member 1
  ENST ID: ENST00000619669
  CDS Start-End: 14-808
cagctacgacgccatgaatatcttgcccaagaagagctggcacgtccggaacaaggacaatgtcgcccgcgtgcggcgtgacgaggcccaggcccgggaggaggagaaggagcgtgagcggagggtgctgctggctcagcaagaggcccgtacagaattcctacggaagaaagccagacatcagaactcactgcctgagcttgaagcagcagaggcgggagccccaggttctggccctgtggacctgtttcgggagctgctggaggaagggaaaggagtgatcagaggcaataaagagtacgaggaagaaaagcgacaggagaaagagaggcaagagaaagctctgggcatcctgacatacctgggccagagtgcagcggaggcacagactcaacccccttggtaccagctacccccagggcgagggggccccccgcccggcccagccccagatgagaagatcaagagccgtctggaccctctgcgggagatgcagaagcatctggggaagaagagacagcacggcggtgatgaaggcagtcgcagcagaaaggaaaaggaggggtctgagaagcagcgacccaaggagcctccatccctggaccagcttcgagctgaacgtctgcggagggaagcagctgagaggtctcgggcagaggccctgctggcccgggtccaaggccgggcactacaggagggtcagccggaagaagacgagacggatgaccggcggcggcggtacaactcccaattcaacccccagctggcccggcgcccccgccagcaggaccctcaccttactcactgactcctgagggggtacaggagaggccgctgctgccagccgtcatataaaactatttattcataaatattttccaaaatg

SEQ ID NO: 148747 - DNA, 941 bp, Homo sapiens
  Payload ID: 9421
  Gene Symbol: LENG1
  Gene Name: leukocyte receptor cluster (LRC) member 1
  Uniprot ID: Q96BZ8
  ENST ID: ENST00000613622
  CDS Start-End: 49-843
ggaagtgcaaagaggcgggcgtgccagtccctggacagctacgacgccatgaatatcttgcccaagaagagctggcacgtccggaacaaggacaatgtcgcccgcgtgcggcgtgacgaggcccaggcccgggaggaggagaaggagcgtgagcggagggtgctgctggctcagcaagaggcccgtacagaattcctacggaagaaagccagacatcagaactcactgcctgagcttgaagcagcagaggcgggagccccaggttctggccctgtggacctgtttcgggagctgctggaggaagggaaaggagtgatcagaggcaataaagagtacgaggaagaaaagcgacaggagaaagagaggcaagagaaagctctgggcatcctgacatacctgggccagagtgcagcggaggcacagactcaacccccttggtaccagctacccccagggcgagggggccccccgcccggcccagccccagatgagaagatcaagagccgtctggaccctctgcgggagatgcagaagcatctggggaagaagagacagcacggcggtgatgaaggcagtcgcagcagaaaggaaaaggaggggtctgagaagcagcgacccaaggagcctccatccctggaccagcttcgagctgaacgtctgcggagggaagcagctgagaggtctcgggcagaggccctgctggcccgggtccaaggccgggcactacaggagggtcagccggaagaagacgagacggatgaccggcggcggcggtacaactcccaattcaacccccagctggcccggcgcccccgccagcaggaccctcaccttactcactgactcctgagggggtacaggagaggccgctgctgccagccgtcatataaaactatttattcataaatattttccaaaatgaaaataggtttaccaaaaaa

SEQ ID NO: 148748 - DNA, 886 bp, Homo sapiens; identical to SEQ ID NO: 148746
  Payload ID: 9421
  Gene Symbol: LENG1
  Gene Name: leukocyte receptor cluster (LRC) member 1
  ENST ID: ENST00000621285
  CDS Start-End: 14-808

SEQ ID NO: 148749 - DNA, 886 bp, Homo sapiens; identical to SEQ ID NO: 148746
  Payload ID: 9421
  Gene Symbol: LENG1
  Gene Name: leukocyte receptor cluster (LRC) member 1
  ENST ID: ENST00000616816
  CDS Start-End: 14-808

SEQ ID NO: 148750 - DNA, 886 bp, Homo sapiens; identical to SEQ ID NO: 148746
  Payload ID: 9421
  Gene Symbol: LENG1
  Gene Name: leukocyte receptor cluster (LRC) member 1
  ENST ID: ENST00000617592
  CDS Start-End: 14-808

SEQ ID NO: 148751 - DNA, 943 bp, Homo sapiens
  Payload ID: 9421
  Gene Symbol: LENG1
  Gene Name: leukocyte receptor cluster (LRC) member 1
  Uniprot ID: Q96BZ8
  ENST ID: ENST00000616103
  CDS Start-End: 49-843
ggaagtgcaaagaggcgggcgtgccagtccctggacagctacgacgccatgaatatcttgcccaagaagagctggcacgtccggaacaaggacaatgtcgcccgcgtgcggcgtgacgaggcccaggcccgggaggaggagaaggagcgtgagcggagggtgctgctggctcagcaagaggcccgtacagaattcctacggaagaaagccagacatcagaactcactgcctgagcttgaagcagcagaggcgggagccccaggttctggccctgtggacctgtttcgggagctgctggaggaagggaaaggagtgatcagaggcaataaagagtacgaggaagaaaagcgacaggagaaagagaggcaagagaaagctctgggcatcctgacatacctgggccagagtgcagcggaggcacagactcaacccccttggtaccagctacccccagggcgagggggccccccgcccggcccagccccagatgagaagatcaagagccgtctggaccctctgcgggagatgcagaagcatctggggaagaagagacagcacggcggtgatgaaggcagtcgcagcagaaaggaaaaggaggggtctgagaagcagcgacccaaggagcctccatccctggaccagcttcgagctgaacgtctgcggagggaagcagctgagaggtctcgggcagaggccctgctggcccgggtccaaggccgggcactacaggagggtcagccggaagaagacgagacggatgaccggcggcggcggtacaactcccaattcaacccccagctggcccggcgcccccgccagcaggaccctcaccttactcactgactcctgagggggtacaggagaggccgctgctgccagccgtcatataaaactatttattcataaatattttccaaaatgaaaataggtttaccaaaaaatg

SEQ ID NO: 148752 - DNA, 890 bp, Homo sapiens
  Payload ID: 9421
  Gene Symbol: LENG1
  Gene Name: leukocyte receptor cluster (LRC) member 1
  Uniprot ID: Q96BZ8
  ENST ID: ENST00000610998
  CDS Start-End: 14-808
cagctacgacgccatgaatatcttgcccaagaagagctggcacgtccggaacaaggacaatgtcgcccgcgtgcggcgtgacgaggcccaggcccgggaggaggagaaggagcgtgagcggagggtgctgctggctcagcaagaggcccgtacagaattcctacggaagaaagccagacatcagaactcactgcctgagcttgaagcagcagaggcgggagccccaggttctggccctgtggacctgtttcgggagctgctggaggaagggaaaggagtgatcagaggcaataaagagtacgaggaagaaaagcgacaggagaaagagaggcaagagaaagctctgggcatcctgacatacctgggccagagtgcagcggaggcacagactcaacccccttggtaccagctacccccagggcgagggggccccccgcccggcccagccccagatgagaagatcaagagccgtctggaccctctgcgggagatgcagaagcatctggggaagaagagacagcacggcggtgatgaaggcagtcgcagcagaaaggaaaaggaggggtctgagaagcagcgacccaaggagcctccatccctggaccagcttcgagctgaacgtctgcggagggaagcagctgagaggtctcgggcagaggccctgctggcccgggtccaaggccgggcactacaggagggtcagccggaagaagacgagacggatgaccggcggcggcggtacaactcccaattcaacccccagctggcccggcgcccccgccagcaggaccctcaccttactcactgactcctgagggggtacaggagaggccgctgctgccagccgtcatataaaactatttattcataaatattttccaaaatgaaaa

SEQ ID NO: 148753 - DNA, 886 bp, Homo sapiens; identical to SEQ ID NO: 148746
  Payload ID: 9421
  Gene Symbol: LENG1
  Gene Name: leukocyte receptor cluster (LRC) member 1
  Uniprot ID: Q96BZ8
  ENST ID: ENST00000621927
  CDS Start-End: 14-808

SEQ ID NO: 148754 - DNA, 886 bp, Homo sapiens; identical to SEQ ID NO: 148746
  Payload ID: 9421
  Gene Symbol: LENG1
  Gene Name: leukocyte receptor cluster (LRC) member 1
  ENST ID: ENST00000614037
  CDS Start-End: 14-808

SEQ ID NO: 148755 - DNA, 3991 bp, Homo sapiens
  Payload ID: 9422
  Gene Symbol: LENG8
  Gene Name: leukocyte receptor cluster (LRC) member 8
  Uniprot ID: Q96PV6
  ENST ID: ENST00000326764
  CDS Start-End: 480-2882
ccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtctcctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctggttgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaaccttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagagcgtgcacgctcctgctttgtc

SEQ ID NO: 148756 - DNA, 5146 bp, Homo sapiens
  Payload ID: 9422
  Gene Symbol: LENG8
  Gene Name: leukocyte receptor cluster (LRC) member 8
  ENST ID: ENST00000376514
  CDS Start-End: 139-2652
cagccgggtggcacagcggtgtcgtggccgtgttgctgatcgcctgggtggttgttggcgtgtccctgcagcgaaggatcctgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgggccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacaga

SEQ ID NO: 148757 - DNA, 463 bp, Homo sapiens
  Payload ID: 9422
  Gene Symbol: LENG8
  Gene Name: leukocyte receptor cluster (LRC) member 8
  ENST ID: ENST00000443957
  CDS Start-End: 189-463
tcctgcgcgtctttctggggcgtggtgcgcaggcgcggcctgggcagtggctccgtggctagtcgtggggatccgagcggcctcctccacccggcgtcctcctttgccttcgcccagcctgcgggacggccagacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagca

SEQ ID NO: 148758 - DNA, 594 bp, Homo sapiens
  Payload ID: 9422
  Gene Symbol: LENG8
  Gene Name: leukocyte receptor cluster (LRC) member 8
  ENST ID: ENST00000421200
  CDS Start-End: 1-336
caccgctttttccggctctactgccatgcaccctgcatgtctggctacctcgtggacaagtttgcagatcgggagcgcaaggtcgccctcaaggccatgatcaaaactgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatgg

SEQ ID NO: 148759 - DNA, 1073 bp, Homo sapiens
  Payload ID: 9422
  Gene Symbol: LENG8
  Gene Name: leukocyte receptor cluster (LRC) member 8
  ENST ID: ENST00000439657
  CDS Start-End: 173-1073
cggtcaggacgtcgaagccaaagaagaccagagccagccgggtggcacagcggtgtcgtggccgtgttgctgatcgcctgggtggttgttggcgtgtccctgcagcgaaggatcctgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgct

SEQ ID NO: 148760 - DNA, 320 bp, Homo sapiens
  Payload ID: 9422
  Gene Symbol: LENG8
  Gene Name: leukocyte receptor cluster (LRC) member 8
  ENST ID: ENST00000436479
  CDS Start-End: 96-320
cgggtggcacagcggtgtcgtggccgtgttgctgatcgcctgggtggttgttggcgtgtccctgcagcgaaggatcctggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtac

SEQ ID NO: 148761 - DNA, 2825 bp, Homo sapiens
  Payload ID: 9422
  Gene Symbol: LENG8
  Gene Name: leukocyte receptor cluster (LRC) member 8
  ENST ID: ENST00000616932
  CDS Start-End: 480-2825
ccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtctcctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctggttgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgtctcaagttgtataaagttgtctccgtgtcccctcctccctctgcccccagtgtttcttctgatttttttttcccctttccctccctccctctccgcattcttcccttggttcagcacaggtaaaacggttcccccctccctccctccctcttctgccatgtaa

SEQ ID NO: 148762 - DNA, 393 bp, Homo sapiens
  Payload ID: 9422
  Gene Symbol: LENG8
  Gene Name: leukocyte receptor cluster (LRC) member 8
  ENST ID: ENST00000613722
  CDS Start-End: 119-393
atccgagcggcctcctccacccggcgtcctcctttgccttcgcccagcctgcgggacggccaggcagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagca

SEQ ID NO: 148763 - DNA, 4138 bp, Homo sapiens
  Payload ID: 9422
  Gene Symbol: LENG8
  Gene Name: leukocyte receptor cluster (LRC) member 8
  Uniprot ID: Q96PV6
  ENST ID: ENST00000621306
  CDS Start-End: 648-3050
gtcaggagttcgagaacagcctggccgacatggtgaaaccccgtctttactaaaaacacaaaaattagccgggcatagtggcgcgcgcctgtaatcccagctactccggaggctgaggcagaattgtttgaacccaggaggcggaggttgcagtgagcagagatcacgccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtctcctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctggttgacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaaccttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagag

SEQ ID NO: 148764 - DNA, 5789 bp, Homo sapiens
  Payload ID: 9422
  Gene Symbol: LENG8
  Gene Name: leukocyte receptor cluster (LRC) member 8
  ENST ID: ENST00000610347
  CDS Start-End: 56-2680
acagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgggccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagaga

SEQ ID NO: 148765 - DNA, 4138 bp, Homo sapiens
  Payload ID: 9422
  Gene Symbol: LENG8
  Gene Name: leukocyte receptor cluster (LRC) member 8
  Uniprot ID: Q96PV6
  ENST ID: ENST00000622672
  CDS Start-End: 648-3050
gtcaggagttcgagaacagcctggccgacatggtgaaaccccgtctttactaaaaacacaaaaattagccgggcatagtggcgcgcgcctgtaatcccagctactccggaggctgaggcagaattgtttgaacccaggaggcggaggttgcagtgagcagagatcacgccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctggttggcagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaagcccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagcccgatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaaccttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagag

SEQ ID NO: 148766 - DNA, 2825 bp, Homo sapiens
  Payload ID: 9422
  Gene Symbol: LENG8
  Gene Name: leukocyte receptor cluster (LRC) member 8
  ENST ID: ENST00000611866
  CDS Start-End: 480-2825
ccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgcagggccgagggaggcggtgcaaggccgccgcgtgacgtcaggacgccgcggtcaggacgtcgaagccaaagaagaccagagccagccgggtggcacagcggtgtcgtggccgtgttgctgatcgcctgggtggttgttggcgtgtccctgcagcgaaggatcctggttggcagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaagcccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagcccgatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgtctcaagttgtataaagttgtctccgtgtcccctcctccctctgcccccagtgtttcttctgatttttttttcccctttccctccctccctctccgcattcttcccttggttcagcacaggtaaaacggttcccccctccctccctccctcttctgccatgtaa

SEQ ID NO: 148767 - DNA, 3635 bp, Homo sapiens
  Payload ID: 9422
  Gene Symbol: LENG8
  Gene Name: leukocyte receptor cluster (LRC) member 8
  Uniprot ID: Q96PV6
  ENST ID: ENST00000617180
  CDS Start-End: 145-2547
gccagccgggtggcacagcggtgtcgtggccgtgttgctgatcgcctgggtggttgttggcgtgtccctgcagcgaaggatcctggttggcagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaagcccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagcccgatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaaccttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacagactcttgttcccagccccttggggcctccgtgtttggggtgggggagctgcttagagactgtgcccgtcctcggccccccaccctgaagtgccagcaccaccagcaccagatcctccgccgccacaccgcactgaggacacgccggccgggccgcctcgtctcaagttgtataaagttgtctccgtgtcccctcctccctctgcccccagtgtttcttctgatttttttttcccctttccctccctccctctccgcattcttcccttggttcagcacaggtaaaacggttcccctccctccctgccttcatggatcaccagctcacgtcatgttgccttctcttttctttgtgtgtgtgtttatttaagttatttttcttcctcctctcccttttctttttggccctccctccctccctcttctgccatgtaactggaggatgtgctatgagtttgcaaacagctggactgtcaggctgctttttttccagatgttcctcctctgcctccccttcccctcctctcccctccttttccttccttccttcctttccttggagcactgagcaccatttggaagcttgagagaaaccaaaattaaagagagaaagagagag

SEQ ID NO: 148768 - DNA, 582 bp, Homo sapiens
  Payload ID: 9422
  Gene Symbol: LENG8
  Gene Name: leukocyte receptor cluster (LRC) member 8
  ENST ID: ENST00000613009
  CDS Start-End: 128-582
gtcgaagccaaagaagaccagagccagccgggtggcacagcggtgtcgtggccgtgttgctgatcgcctgggtggttgttggcgtgtccctgcagcgaaggatcctggttggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccaca

SEQ ID NO: 148769 - DNA, 393 bp, Homo sapiens
  Payload ID: 9422
  Gene Symbol: LENG8
  Gene Name: leukocyte receptor cluster (LRC) member 8
  ENST ID: ENST00000620984
  CDS Start-End: 119-393
atccgagcggcctcctccacccggcgtcctcctttgccttcgcccagcctgcgggacggccagacagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagca

SEQ ID NO: 148770 - DNA, 2825 bp, Homo sapiens; identical to SEQ ID NO: 148761
  Payload ID: 9422
  Gene Symbol: LENG8
  Gene Name: leukocyte receptor cluster (LRC) member 8
  ENST ID: ENST00000617420
  CDS Start-End: 480-2825

SEQ ID NO: 148771 - DNA, 4673 bp, Homo sapiens
  Payload ID: 9422
  Gene Symbol: LENG8
  Gene Name: leukocyte receptor cluster (LRC) member 8
  ENST ID: ENST00000617297
  CDS Start-End: 1-2179
tgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaaacccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagccggatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttcgcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccacgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttccccccaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaaccccccccgggccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacaga

SEQ ID NO: 148772 - DNA, 4674 bp, Homo sapiens
  Payload ID: 9422
  Gene Symbol: LENG8
  Gene Name: leukocyte receptor cluster (LRC) member 8
  ENST ID: ENST00000619260
  CDS Start-End: 1-2179
tgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgccacgggccaggcctatgggccacacacctacaccgaacctgccaagcccaagaagggccaacagctgtggaaccgcatgaagcccgcccctgggactggaggtctcaagttcaacatccagaagcgaccctttgctgttaccacccagagctttggctccaacgcagagggccagcacagtggttttggcccccagcccaaccctgagaaagttcagaaccacagcgggtcctctgcccgggggaacctgtctgggaagcccgatgactggccccaggacatgaaagagtatgtggagcgctgcttcaccgcctgtgagtcggaggaggacaaggaccgcacggaaaagctgctcaaggaggtgctgcaggcgcggctgcaggacggctcggcctataccattgactggagccgggagcccttgccggggctgacccgggagcctgtggctgagagccctaagaagaagcggtgggaggccgctagcagccttcaccctcctagaggggcaggctcggcgacaaggggcgggggtgccccgtcccagcgagggacgcccggggctgggggtgccggtcgagcccggggcaacagcttcaccaagtttggcaaccgcaacgtcttcatgaaggacaacagctcttcttccagcacagactcccgctcccgctcctcctccaggtccccgacgcgccacttccgcagaagtgactcccactcagactccgacagctcctactcagggaatgagtgtcaccctgtgggccgcaggaacccgccccctaagggccggggcggtcgaggggcccatatggatcggggccgaggcagggcgcagcgtgggaagaggcacgatctggcgcccaccaagcgcagtcgaaagaagatggcggcgctggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagtttactgcctaccgaatcctctactacatcttcaccaagaactcgggagacatcaccacggagctggcatacctcacacgagaactgaaggcagatccttgcgtggcccacgccttggcattaaggacagcctgggccctgggcaactaccaccgctttttccggctctactgccatgcaccctgcatgtctggctacctcgtggacaagtttgcagatcgggagcgcaaggtcgccctcaaggccatgatcaaaacgtatgtggtgccaagctcccttctgcctttgctcttcccatccttccgcctcgcaccgcccctcagaccagctcctggccgcaggcctcccccagcccccaacccttgtcctggtccttgcttccccatcatctttctccattcagccctcccctctccagttcctcttgctctccttgttggtcacctctgtgttccgggtcactcctctccctctccccactgttcccagctcactgcctctggggcctcttctccaccccatctgtgtgtctcttcctcctgttctctcctgcctggaccccctagttcactccttgccctgggcttcctcagaaccctgaggtctctgctttctcagcttgtcgctgtgctcccaccatagagaccatctagacagcctctggtctaccaggacaaggcccagtcccactcagctcctttgagagcaccagaaacgcttagggagacacctgtgttgaggccacactgggcgcggtgccagaggcccctggtcaggccatgcccctgcagtgtccttcgttcactagacattgcgcctggcttgctgtgggtggggatgagttgcttgactcatgtttagacgcatggttctgtctggtgattgaggtgcccaggcgacgctgggcaatgtcaagagaggttttggcttgtcacagcaaggggatgctcttggcatctagtgagtggaggccagggatgctgccctgccactgccattgggcctcagagctcagtcttgccaaggtggagaaattctggtcgaagaggttgaccggtagactgaagaggccttgagagcctggccaggtggctgtccacgtgaggtcatagtcacagcatggaggccttgagagcctggccaggtggccctccacgtgaggtcatggtcacagcatgggggccttgagtgcctggccaggtggccctccacgtgaggtcatggtcacagcatggaggccttgagagcctggccaggtggccctccatgtgaggttgtggtcacagcatgggggccttgagagcctggccaggtggccctccacgtgaggtcatggtcacagcatggaggccttgagagcctggccaggtggccctccgtgtgaggtcatggtcacagcatagtttggagctagggagggactgtcagcctggaggtttggagactcattctggaatctagtgtgggtcaagccaacttcagggagaggctgagccagggtaggagtcacaggagcagacgaggatgtggggtgccgtgcacagagctccatgaccagcttgggaagttagaaggaaggggaggcaggaggctgcttagtctgctgccatgatgggccccatgaatggtggctctcaagcttctgtgctacacaggggtgtgtggttgggcgagtgtccttgttaattgatacctaattggccttggttgggaacatagccatgagtgcccctcgtgggtggggcgccagtctgtcattgacctcattgtgtcagcaccttcccctcaaggaggctgaccctgccctgccagctgagactgggagacggagtgggctctgatcccagggcttccaggaaagctctggctttggagcagaagcgggttctaggacttagtgcccctcactcggtgcctgggttcctgtgtgtgtggaaagggtagggctgcaccctgtggaagagggttcagggagctctgaggacctggctcgtgctagatgctcagtcagtagtgtgttttagcagcagccggaagtgactgctttcagtgtgtagtggtgagtgctagctggcacccctgcgcctggcttcccagacactgtaacgcagggcaggggaggcagcgagggctgggtccccacggtggccctggcagccccgccatccccatcccctgccacgtgctgctccctccatctggtccctgcccctcagccagcggaggagcccgctgggcccttccctgcccgtccccgctcctccctggcccccgcacaggtaagtgagggtgaggggggcacaggggactggggtcactaacccccccccgggccccccccgagcccctgaggtggggaggctgggaggcgggtggggagccagcaggcactgtgctgaggaaatcctgtgggcacccgaatgggggggcctccccgctcgtggggccctcccctgccctcccgcccgcccgcctcatcaccttctcctcttgtctccatagcttccgccctgcgctgccagtctcctacctgcaggccgagctggccttcgagggcgaggccgcctgccgggccttcctagagcccctgggcctggcctacacgggcccggacaactccagcatcgactgccgcctcagcctggcgcagctgtcagccttctgagcacccagcgaggaggggcgggggcaggggctgcagcccccagcgctgcctttgcggattctgtttttgagccgtggacttgggttgtaaatttatttgtggggagtgcgctccaggaagagccaccatccctgcccccgttttcccaccggggagtctgtacagagatttttctacgtttttattttttgcctcagagggatgggattggggaggaggggatgggcagcggagggttgggggcatggtctgcaggctcatctgtgtccgcctttcactccactaatgctgtctcagtgttttctctctctctctttcgagcttgcactccggtacccgacccggcgccctggcccatcccatgccggggggccagtggaaagaagacaggccgtccagcccgtgcccgcctgcggcgggggcacccagcaagcccgcccaccgcccgctgcctcacctgcttcgccacaga

SEQ ID NO: 148773 - DNA, 4674 bp, Homo sapiens; identical to SEQ ID NO: 148772
  Payload ID: 9422
  Gene Symbol: LENG8
  Gene Name: leukocyte receptor cluster (LRC) member 8
  ENST ID: ENST00000611878
  CDS Start-End: 1-2179

SEQ ID NO: 148774 - DNA, 393 bp, Homo sapiens; identical to SEQ ID NO: 148762
  Payload ID: 9422
  Gene Symbol: LENG8
  Gene Name: leukocyte receptor cluster (LRC) member 8
  ENST ID: ENST00000614139
  CDS Start-End: 119-393

SEQ ID NO: 148775 - DNA, 742 bp, Homo sapiens
  Payload ID: 9422
  Gene Symbol: LENG8
  Gene Name: leukocyte receptor cluster (LRC) member 8
  ENST ID: ENST00000614208
  CDS Start-End: 145-742
cagagccagccgggtggcacagcggtgtcgtggccgtgttgctgatcgcctgggtggttgttggcgtgtccctgcagcgaaggatcctggcagtgaaaaagcagtctggctcccgaggtccaccccttataccccaaggtccagatggcggccaacgtgggtgatcaacgtagcacagattggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacagtacgtgtcccaggcagaagcctcagctttgcagcagcagcagtactaccagtggtaccagcagtacaactatgcctacccctacagctactactatcccatgagcatgtaccagagctatggctccccttcccagtatgggatggccggctcctatggctcagccacaccccagcagccatccgcaccccaacaccaagggactctgaaccagcccccagtccccggcatggatgagagcatgtcctaccaggctccccctcagcagctgccgtcggctcagccccctcagccctcaaatcccccacatggggctcacacgctgaacagtggccctcagcctgggacagctccagccacacagcacagccaggcggggcccgcca

SEQ ID NO: 148776 - DNA, 2825 bp, Homo sapiens; identical to SEQ ID NO: 148766
  Payload ID: 9422
  Gene Symbol: LENG8
  Gene Name: leukocyte receptor cluster (LRC) member 8
  ENST ID: ENST00000610314
  CDS Start-End: 480-2825

SEQ ID NO: 148777 - DNA, 594 bp, Homo sapiens; identical to SEQ ID NO: 148758
  Payload ID: 9422
  Gene Symbol: LENG8
  Gene Name: leukocyte receptor cluster (LRC) member 8
  ENST ID: ENST00000611220
  CDS Start-End: 1-336

SEQ ID NO: 148778 - DNA, 1919 bp, Homo sapiens
  Payload ID: 9423
  Gene Symbol: LENG9
  Gene Name: leukocyte receptor cluster (LRC) member 9
  Uniprot ID: Q96B70
  ENST ID: ENST00000622419
  CDS Start-End: 120-1625
aggctctccaccaaggagggactgggccagagtcctcgcgagggcacgcggcgtggtccccagagctaggccggagcgcgggccgctgacgccactgtcgggtgaggctcggtgcatccatggggagccgccctccgtgcggggcgacctcgtctgcgcggcgggcgtgccagttccccgcacccatggcagcggccagagagccggagttgccgcaggaagcccccgccacggaacccgcgcccccgccggcctgccgcttcttcctggaaggccgctgccgcttcggcgcccgctgccgccagccccaccctggggcgccggcgccgcctggccgcgaggcgcagccggaggccggggccaagaagccgccgctgcgcacagccgcggacgtcatccagcgcatccgctgggacccgcgcctcgaccccgccgacttctcggtgggctacgtcgaccgctttctgggtgtgcgcgaggagcccttcagcgccttttgctgggaccagccgctggcggcgctcgggccgggcgtgctggcagtgccccagcaccgcgtgcgcttcttccgcttccatggccgccttgtgtgggaccgcgcctcgcgcaccgacctcgtctttggctctggctcggcggcgggacgcgggcccaccatcctggacgcaccgaacaccgagggcgcccacggggcagagggtgccgagtggacactggcggggacaggtcaggaggcccaggctgcccccaagcgagggagcacaaggccgctctgcacagggcaccaggaaccaggcgtggaggaacccggagagctggaggcggcccaggagagggcgctgggcacagctgctgatttgggaacactggccccaagaggacgcctcgccggagtgactgaggaggcactgaagccaacagcagccaccaggaccacattgctggggggcaaggaagcacaggccctgggagtcccggggggctccgctgagacgacagaagccgagtggggtcctgcggcctggcccgaggacaaaagggcccgccttagtgttgcagccccttgccaaccgcgccccacacattttgtggccctcatggtgaccgagcctgggctacaagcagaagtgaccaaggcccaggaatacctggtccacgtggccccacactgcgccaacttcctagtgccctctcagaacctacacctgaccctggccctgctgcgactggcaggcgctggggaggaggccgctgccattggagctctgagacgggccctcttggccccggggctaaatgcaccccctcggctgagctttagaaagctggtcctcctgggcccgcatgtgctgtgtgccccaccctctcccacactggaaagcatggcacaagtgctgagccagaggctggaagccgaggggctgagtacactacagtctccagggcagctgcacccccacctcaccgtggccaaggtgccccatggttcccaggtccacctccccaagctggagttcaccctcagccaggaagtggggtgccagcccctgcagacactctggctgtgccgtatagggaggacaggggggcctttccagcccctggctgagatccgcctggagtgacacccccagacctctggaggagacaatggatgcaaacagcccacacaggaaagacaaagcaggagcgtgcacgctctctctttctctctttaattttggtttctctcaagcttccaaatggtgctcagtgctccaaggaaaggaaggaaggaaggaaaaggaggggagaggaggggaaggggaggcagaggaggaacatctggaaaaaaagcagcctgacagtccagctgtttgcaaactcatagcacatcctccagttacatggcagaagagggagggagggagggccaaaaa

SEQ ID NO: 148779 - DNA, 1921 bp, Homo sapiens
  Payload ID: 9423
  Gene Symbol: LENG9
  Gene Name: leukocyte receptor cluster (LRC) member 9
  ENST ID: ENST00000622643
  CDS Start-End: 186-1622
aggctctccaccaaggagggactgggccagagtcctcgcgagggcacgcggcgtggtccccagagctaggccggagcgcgggccgctgacgccactgtcgggtgaggctcggtgcatccaaggggagccgccctccgtgcggggcgacctcgtctgcgcggcgggcgtgccagttccccgcacccatggcagcggccagagagccggagttgccgcaggaagcccccgccacggaacccgcgcccccgccggcctgccgcttcttcctggaaggccgctgccgcttcggcgcccgctgccgccagccccaccctggggcgccggcgccgcctggccgcgaggcgcagccggaggccggggccaagaagccgccgctgcgcacagccgcggacgtcatccagcgcatccgctgggacccgcgcctcgaccccgccgacttctcggtgggctacgtcgaccgctttctgggtgtgcgcgaggagcccttcagcgccttttgctgggaccagccgctggcggcgctcgggccgggcgtgctggcagtgccccagcaccgcgtgcgcttcttccgcttccgtggccgccttgtgtgggaccgcgcctcgcgcaccgacctcgtctttggctctggctcggcggcgggacgcgggcccaccatcctggacgcaccgaacaccgagggcgcccacggggcagagggtgccgagtggacactggcggggacaggtcaggaggcccaggctgcccccaagcgagggagcacaaggccgctctgcacagggcaccaggaaccaggcgtggaggaacccggagagctggaggcggcccaggagagggcgctgggcacagctgctgatttgggaacactggccccaagaggacgcctcgccggagtgactgaggcactgaagccaacagcagccaccaggaccacattgctggggggcaaggaagcacaggccctgggagtcccggggggctccgctgagacgacagaagccgagtggggtcctgcggcctggcccgaggacaaaagggcccgccttagtgttgcagccccttgccaaccgcgccccacacattttgtggccctcatggtgaccgagcctgggctacaagcagaagtgaccaaggcccaggaatacctggtccacgtggccccacactgcgccaacttcctagtgccctctcagaacctacacctgaccctggccctgctgcgactggcaggcgctggggaggaggccgctgccattggagctctgagacgggccctcttggccccggggctaaatgcaccccctcggctgagctttagaaagctggtcctcctgggcccgcatgtgctgtgtgccccaccctctcccacactggaaagcatggcacaagtgctgagccagaggctggaagccgaggggctgagtacactacagtctccagggcagctgcacccccacctcaccgtggccaaggtgccccatggttcccaggtccacctccccaagctggagttcaccctcagccaggaagtggggtgccagcccctgcagacactctggctgtgccgtatagggaggacaggggggcctttccagcccctggctgagatccccctggagtgacacccccagacctctggaggagacaatggatgcaaacagcccacacaggaaagacaaagcaggagcgtgcacgctctctctttctctctttaattttggtttctctcaagcttccaaatggtgctcagtgctccaaggaaaggaaggaaggaaggaaaaggaggggagaggaggggaaggggaggcagaggaggaacatctggaaaaaaagcagcctgacagtccagctgtttgcaaactcatagcacatcctccagttacatggcagaagagggagggagggagggccaaaaagaaaa

SEQ ID NO: 148780 - DNA, 1916 bp, Homo sapiens
  Payload ID: 9423
  Gene Symbol: LENG9
  Gene Name: leukocyte receptor cluster (LRC) member 9
  ENST ID: ENST00000611161
  CDS Start-End: 186-1622
aggctctccaccaaggagggactgggccagagtcctcgcgagggcacgcggcgtggtccccagagctaggccggagcgcgggccgctgacgccactgtcgggtgaggctcggtgcatccaaggggagccgccctccgtgcggggcgacctcgtctgcgcggcgggcgtgccagttccccgcacccatggcagcggccagagagccggagttgccgcaggaagcccccgccacggaacccgcgcccccgccggcctgccgcttcttcctggaaggccgctgccgcttcggcgcccgctgccgccagccccaccctggggcgccggcgccgcctggccgcgaggcgcagccggaggccggggccaagaagccgccgctgcgcacagccgcggacgtcatccagcgcatccgctgggacccgcgcctcgaccccgccgacttctcggtgggctacgtcgaccgctttctgggtgtgcgcgaggagcccttcagcgccttttgctgggaccagccgctggcggcgctcgggccgggcgtgctggcagtgccccagcaccgcgtgcgcttcttccgcttccgtggccgccttgtgtgggaccgcgcctcgcgcaccgacctcgtctttggctctggctcggcggcgggacgcgggcccaccatcctggacgcaccgaacaccgagggcgcccacggggcagagggtgccgagtggacactggcggggacaggtcaggaggcccaggctgcccccaagcgagggagcacaaggccgctctgcacagggcaccaggaaccaggcgtggaggaacccggagagctggaggcggcccaggagagggcgctgggcacagctgctgatttgggaacactggccccaagaggacgcctcgccggagtgactgaggcactgaagccaacagcagccaccaggaccacattgctggggggcaaggaagcacaggccctgggagtcccggggggctccgctgagacgacagaagccgagtggggtcctgcggcctggcccgaggacaaaagggcccgccttagtgttgcagccccttgccaaccgcgccccacacattttgtggccctcatggtgaccgagcctgggctacaagcagaagtgaccaaggcccaggaatacctggtccacgtggccccacactgcgccaacttcctagtgccctctcagaacctacacctgaccctggccctgctgcgactggcaggcgctggggaggaggccgctgccattggagctctgagacgggccctcttggccccggggctaaatgcaccccctcggctgagctttagaaagctggtcctcctgggcccgcatgtgctgtgtgccccaccctctcccacactggaaagcatggcacaagtgctgagccagaggctggaagccgaggggctgagtacactacagtctccagggcagctgcacccccacctcaccgtggccaaggtgccccatggttcccaggtccacctccccaagctggagttcaccctcagccaggaagtggggtgccagcccctgcagacactctggctgtgccgtatagggaggacaggggggcctttccagcccctggctgagatccccctggagtgacacccccagacctctggaggagacaatggatgcaaacagcccacacaggaaagacaaagcaggagcgtgcacgctctctctttctctctttaattttggtttctctcaagcttccaaatggtgctcagtgctccaaggaaaggaaggaaggaaggaaaaggaggggagaggaggggaaggggaggcagaggaggaacatctggaaaaaaagcagcctgacagtccagctgtttgcaaactcatagcacatcctccagttacatggcagaagagggagggagggagggccaaaaa

SEQ ID NO: 148781 - DNA, 1924 bp, Homo sapiens
  Payload ID: 9423
  Gene Symbol: LENG9
  Gene Name: leukocyte receptor cluster (LRC) member 9
  Uniprot ID: Q96B70
  ENST ID: ENST00000614111
  CDS Start-End: 120-1625
aggctctccaccaaggagggactgggccagagtcctcgcgagggcacgcggcgtggtccccagagctaggccggagcgcgggccgctgacgccactgtcgggtgaggctcggtgcatccatggggagccgccctccgtgcggggcgacctcgtctgcgcggcgggcgtgccagttccccgcacccatggcagcggccagagagccggagttgccgcaggaagcccccgccacggaacccgcgcccccgccggcctgccgcttcttcctggaaggccgctgccgcttcggcgcccgctgccgccagccccaccctggggcgccggcgccgcctggccgcgaggcgcagccggaggccggggccaagaagccgccgctgcgcacagccgcggacgtcatccagcgcatccgctgggacccgcgcctcgaccccgccgacttctcggtgggctacgtcgaccgctttctgggtgtgcgcgaggagcccttcagcgccttttgctgggaccagccgctggcggcgctcgggccgggcgtgctggcagtgccccagcaccgcgtgcgcttcttccgcttccatggccgccttgtgtgggaccgcgcctcgcgcaccgacctcgtctttggctctggctcggcggcgggacgcgggcccaccatcctggacgcaccgaacaccgagggcgcccacggggcagagggtgccgagtggacactggcggggacaggtcaggaggcccaggctgcccccaagcgagggagcacaaggccgctctgcacagggcaccaggaaccaggcgtggaggaacccggagagctggaggcggcccaggagagggcgctgggcacagctgctgatttgggaacactggccccaagaggacgcctcgccggagtgactgaggaggcactgaagccaacagcagccaccaggaccacattgctggggggcaaggaagcacaggccctgggagtcccggggggctccgctgagacgacagaagccgagtggggtcctgcggcctggcccgaggacaaaagggcccgccttagtgttgcagccccttgccaaccgcgccccacacattttgtggccctcatggtgaccgagcctgggctacaagcagaagtgaccaaggcccaggaatacctggtccacgtggccccacactgcgccaacttcctagtgccctctcagaacctacacctgaccctggccctgctgcgactggcaggcgctggggaggaggccgctgccattggagctctgagacgggccctcttggccccggggctaaatgcaccccctcggctgagctttagaaagctggtcctcctgggcccgcatgtgctgtgtgccccaccctctcccacactggaaagcatggcacaagtgctgagccagaggctggaagccgaggggctgagtacactacagtctccagggcagctgcacccccacctcaccgtggccaaggtgccccatggttcccaggtccacctccccaagctggagttcaccctcagccaggaagtggggtgccagcccctgcagacactctggctgtgccgtatagggaggacaggggggcctttccagcccctggctgagatccgcctggagtgacacccccagacctctggaggagacaatggatgcaaacagcccacacaggaaagacaaagcaggagcgtgcacgctctctctttctctctttaattttggtttctctcaagcttccaaatggtgctcagtgctccaaggaaaggaaggaaggaaggaaaaggaggggagaggaggggaaggggaggcagaggaggaacatctggaaaaaaagcagcctgacagtccagctgtttgcaaactcatagcacatcctccagttacatggcagaagagggagggagggagggccaaaaagaaaa

SEQ ID NO: 148782 - DNA, 3046 bp, Homo sapiens
  Payload ID: 9424
  Gene Symbol: LTK
  Gene Name: leukocyte receptor tyrosine kinase
  Uniprot ID: P29376
  ENST ID: ENST00000263800
  CDS Start-End: 98-2692
gccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcaggtggtgggggcggctggacgtcgcgggctccctctccgcaggccggccgctcactgcaggagggggcggagggcggccagggctgctccgaggcttgggcgacccttggctgggccgcggccggcggcttcgggggcggcggcggggcctgcactgcgggcggaggcggcggcggctacagggggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctggtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcatccttcatctgggcagaccccccaccctgcagatgcttctaataaaaagctcttctcatc

SEQ ID NO: 148783 - DNA, 2940 bp, Homo sapiens
  Payload ID: 9424
  Gene Symbol: LTK
  Gene Name: leukocyte receptor tyrosine kinase
  Uniprot ID: P29376
  ENST ID: ENST00000355166
  CDS Start-End: 171-2582
aggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcagggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctggtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcatccttcatctgggcagaccccccaccctgcagatgcttctaataaaaagctcttctcatcctcc

SEQ ID NO: 148784 - DNA, 2412 bp, Homo sapiens
  Payload ID: 9424
  Gene Symbol: LTK
  Gene Name: leukocyte receptor tyrosine kinase
  Uniprot ID: P29376
  ENST ID: ENST00000453182
  CDS Start-End: 179-2383
ggggtctgaggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcagggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctgggtggggcttggcccggcccagtcctggcctctgccaccaggtgtcaccgaggtttccccagccaatgttactctgctcagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactg

SEQ ID NO: 148785 - DNA, 1821 bp, Homo sapiens
  Payload ID: 9424
  Gene Symbol: LTK
  Gene Name: leukocyte receptor tyrosine kinase
  ENST ID: ENST00000561619
  CDS Start-End: 88-1776
ccgtggcaaaatgagctgtcaactttaggttgacaggggtgtggccgcgaccgcaagggcttttgttgccgggtggacccaacagggatgggctgctggggacagctgctggtgtggttcggagccgcggggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctgggtacgaagcgtctagcaggcacagttgattcaaggctgctcctctccatgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccc

SEQ ID NO: 148786 - DNA, 504 bp, Homo sapiens
  Payload ID: 9425
  Gene Symbol: LST1
  Gene Name: leukocyte specific transcript 1
  ENST ID: ENST00000211921
  CDS Start-End: 193-279
cacccacccaggcccaggctccttcccctccatcatccccttaccagcacctagaaccatccagggctgaaaagtcccctccaaaccacgtgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatca
